United States Patent 11,446,398 (REGULATED BIOCIRCUIT SYSTEMS) - sequence listing, part 32

SEQ ID NO: 115557 - DNA, 1985 bp, Homo sapiens
  Payload ID: 2554
  Gene Symbol: CD36
  Gene Name: CD36 molecule (thrombospondin receptor)
  Uniprot ID: P16671
  ENST ID: ENST00000433696
  CDS Start-End: 415-1716
ctttcaattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtcc

SEQ ID NO: 115558 - DNA, 855 bp, Homo sapiens
  Payload ID: 2554
  Gene Symbol: CD36
  Gene Name: CD36 molecule (thrombospondin receptor)
  ENST ID: ENST00000413265
  CDS Start-End: 247-855
gagagttctccttagataagatttcaatatgttaatcatgtgtagaaagaaaattaaaaaggaggaatatgaagaaattcagatatgacattattagttctgccactggtaggcattagaagcaagaaaagggagacggaccgaggaagccactttgaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatcct

SEQ ID NO: 115559 - DNA, 541 bp, Homo sapiens
  Payload ID: 2554
  Gene Symbol: CD36
  Gene Name: CD36 molecule (thrombospondin receptor)
  ENST ID: ENST00000428497
  CDS Start-End: 261-541
ttgctatggcaacccaatttattagtgactgcaaaactaacttagctggcattgtggcaaatctccatattttgctgatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacag

SEQ ID NO: 115560 - DNA, 720 bp, Homo sapiens
  Payload ID: 2554
  Gene Symbol: CD36
  Gene Name: CD36 molecule (thrombospondin receptor)
  ENST ID: ENST00000438020
  CDS Start-End: 292-720
ggcaaacacaaccagagtcttcggtgttaattccctggtcttcccaactagcattctgaaagtgcattaacatttgtggccttgtgctctttcatcggacttctaatgatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggca

SEQ ID NO: 115561 - DNA, 1808 bp, Homo sapiens
  Payload ID: 2554
  Gene Symbol: CD36
  Gene Name: CD36 molecule (thrombospondin receptor)
  Uniprot ID: P16671
  ENST ID: ENST00000432207
  CDS Start-End: 121-1539
aagttgctgagacaagggaagagagatgaggaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtcc

SEQ ID NO: 115562 - DNA, 2298 bp, Homo sapiens
  Payload ID: 2554
  Gene Symbol: CD36
  Gene Name: CD36 molecule (thrombospondin receptor)
  Uniprot ID: P16671
  ENST ID: ENST00000447544
  CDS Start-End: 255-1673
atttgatcctattaagaattgtccaaatgttggagcatttgattgaaaaatccttcttagccattttaaagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttcctta

SEQ ID NO: 115563 - DNA, 565 bp, Homo sapiens
  Payload ID: 2554
  Gene Symbol: CD36
  Gene Name: CD36 molecule (thrombospondin receptor)
  ENST ID: ENST00000426978
  CDS Start-End: 121-565
aagttgctgagacaagggaagagagatgaggaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatct

SEQ ID NO: 115564 - DNA, 1741 bp, Homo sapiens
  Payload ID: 2554
  Gene Symbol: CD36
  Gene Name: CD36 molecule (thrombospondin receptor)
  ENST ID: ENST00000534394
  CDS Start-End: 282-1472
agatgtcaggataaccttaaggatagatgaagggttgagagcctgtgcctcatttctgagttctcagctgctatgccgtggaaatcctgtttactttctgcatctgctcctgcaagactctggagccagtcttgaggtcctacatctccgaaagcaagctcttctagaagttgcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtcc

SEQ ID NO: 115565 - DNA, 569 bp, Homo sapiens
  Payload ID: 2554
  Gene Symbol: CD36
  Gene Name: CD36 molecule (thrombospondin receptor)
  ENST ID: ENST00000482059
  CDS Start-End: 373-569
gactgcagtgtaggactttcctgcagaataccatttgatcctattaagaattgtccaaatgttggagcatttgattgaaaaatccttcttagccattttaaagactcattagtgaaccagaacaataaaccaaacagagaaccatcagataatgggttagcctgggaagaatattaattacaactggagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttg

SEQ ID NO: 115566 - DNA, 496 bp, Homo sapiens
  Payload ID: 2554
  Gene Symbol: CD36
  Gene Name: CD36 molecule (thrombospondin receptor)
  ENST ID: ENST00000488048
  CDS Start-End: 1-199
gaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtagtaaatgattcttcacatttgtgcgccagctacatcatgacccttggtaataccgaccaacaggatgaaaattggatatgctttacttttacaaagcacaccttatcttttagttgaagaaatggtggcactatttctttttttgcactaagcaactgcacatttcaaaaggattattgagatgttatgaaaatctctaccttgcacaaaaaaaaacccagcagcttttaaaattcatcatttccacaactgaattgatttccgtttctacagacctggctcaagcacaaacca

SEQ ID NO: 115567 - DNA, 1922 bp, Homo sapiens
  Payload ID: 2554
  Gene Symbol: CD36
  Gene Name: CD36 molecule (thrombospondin receptor)
  Uniprot ID: P16671
  ENST ID: ENST00000538969
  CDS Start-End: 415-1653
ctttcaattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcatacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtcc

SEQ ID NO: 115568 - DNA, 1914 bp, Homo sapiens
  Payload ID: 2554
  Gene Symbol: CD36
  Gene Name: CD36 molecule (thrombospondin receptor)
  Uniprot ID: P16671
  ENST ID: ENST00000544133
  CDS Start-End: 415-1281
ctttcaattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtcc

SEQ ID NO: 115569 - DNA, 1265 bp, Homo sapiens
  Payload ID: 2555
  Gene Symbol: CD37
  Gene Name: CD37 molecule
  Uniprot ID: P11049
  ENST ID: ENST00000323906
  CDS Start-End: 142-987
aacttcctcttttggggttcttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaa

SEQ ID NO: 115570 - DNA, 1588 bp, Homo sapiens
  Payload ID: 2555
  Gene Symbol: CD37
  Gene Name: CD37 molecule
  ENST ID: ENST00000391859
  CDS Start-End: 170-640
atgcccagaggtgggttccagtagatcaggggtccctttagatcccccagcgcctgagacatggagacctgggagggactgccccatgagtccttggtgcccacaaattccaaggcccctcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagaaagacacaccgacctggaccaagggagacaggcataaacagctccaaagggaaacacacgggaaaaagagagaacaagagaaagaaatagacgccctgaaagaagagacagagacttatgagccgtagaaatagtggaagaaacagaaagacagacctgaagtacacagagctagccattcagtaaggatttgagactggcccagagatgcacagggcccgcctgaggctggcacagcctgagagggggaggggtggggcggggaagataaggcccagcctcactggtggcctctcagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggt

SEQ ID NO: 115571 - DNA, 1204 bp, Homo sapiens
  Payload ID: 2555
  Gene Symbol: CD37
  Gene Name: CD37 molecule
  Uniprot ID: P11049
  ENST ID: ENST00000426897
  CDS Start-End: 316-957
ctggaacttcctcttttggggttcttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaac

SEQ ID NO: 115572 - DNA, 1674 bp, Homo sapiens
  Payload ID: 2555
  Gene Symbol: CD37
  Gene Name: CD37 molecule
  ENST ID: ENST00000535669
  CDS Start-End: 115-927
ctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgaggtgatctggccccgcccccacccgcgatcggccctaaatccctagatggccctgcccttcatttcgcgtccttcggttgcctgggaaggacgagctcagggcggagcgcagcccaccccggccctcccgccgctccacccagcaccggagggtgggggcggcccagcttcagggagccctgattgggtgtacgcagggaaagcctcctgctattggctgcgatctccctcccctttctccgcagatgactgtcatggtgctgagcgtacagctacagcgcagggcactccgccggaaatgcgagccgcacgtgccgggcgctggggattcgagccccgggcccagcctgatcgctgacggcggcggcgggcacagcggcagtctgtggggtggctggggcatggcgggtgcctgccccaactggggagacaaggcaccgcagggcaagctgcccatggccctggggctctggccgctgtgggttcaagacgaggaccagcctgacactggaagtgcgggcgcagaattagaggaggcacaattagaggctgaggcagagggggaagacagatgagcctccaaaataaaggaccctgggcttgcttccgaccttactccttctcagcctctacccccacttgtagcagctattcccgcctcatcagccagccctgcggcagttcccgtcgagccccgcccttttctacctatccccttctccagccccttcccgcccaattcacggccccacccctgacctttctcgcccgggtgggcatcacccccgtctcg

SEQ ID NO: 115573 - DNA, 559 bp, Homo sapiens
  Payload ID: 2555
  Gene Symbol: CD37
  Gene Name: CD37 molecule
  ENST ID: ENST00000595660
  CDS Start-End: 78-559
ctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcattgacaagaccagcttcgtgtcctttgtgggcaggctacaggctcccatccactgctcaccggaggcttcttggagcctgagtcttcttccggcaaatggggttgtgcatacaaacaacaatgatcatgagagccatttctcaagcacttcctatctgtcgggacttgtggctggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggc

SEQ ID NO: 115574 - DNA, 1598 bp, Homo sapiens
  Payload ID: 2555
  Gene Symbol: CD37
  Gene Name: CD37 molecule
  Uniprot ID: P11049
  ENST ID: ENST00000598095
  CDS Start-End: 316-924
ctggaacttcctcttttggggttcttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgaggtgatctggccccgcccccacccgcgatcggccctaaatccctagatggccctgcccttcatttcgcgtccttcggttgcctgggaaggacgagctcagggcggagcgcagcccaccccggccctcccgccgctccacccagcaccggagggtgggggcggcccagcttcagggagccctgattgggtgtacgcagggaaagcctcctgctattggctgcgatctccctcccctttctccgcagatgactgtcatggtgctgagcgtacagctacagcgcagggcactccgccggaaatgcgagccgcacgtgccgggcgctggggattcgagccccgggcccagcctgatcgctgacggcggcggcgggcacagcggcagtctgtggggtggctggggcatggcgggtgcctgccccaactggggagacaaggcaccgcagggcaagctgcccatggccctggggctctggccgctgtgggttcaagacgaggaccagcctgacactggaagtgcgggcgcagaattagaggaggcacaattagaggctgaggcagagggggaagacagatgagcctccaaaataaaggaccctgggcttgcttccgaccttactccttctcagcctctacccccacttgtagcagctattcccgcctcatcagccagccctgcggcagttcccgtcgagccccgcccttttctacctatccccttct

SEQ ID NO: 115575 - DNA, 803 bp, Homo sapiens
  Payload ID: 2555
  Gene Symbol: CD37
  Gene Name: CD37 molecule
  ENST ID: ENST00000594743
  CDS Start-End: 1-763
ggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagatgactgtcatggtgctgagcgtacagctacagcgcagggcactccgccggaaatgcgagccgcacgtgccgggcgctggggattcgagccccgggcccagcctgatcgctgacggcggcggcgggcacagcggcagtctgtggggtggctggggcatggcgggtgcctgccccaactggggagacaaggcaccgcagggcaagctgcccatggccctggggctctggccgctgtgggttcaagacgaggaccagcctgacactggaagtgcgggcgcagaattagaggaggcacaattagaggctgaggcagagggggaagacagatgagcctccaaaataaaggaccctgggcttgcttccgacctta

SEQ ID NO: 115576 - DNA, 330 bp, Homo sapiens
  Payload ID: 2555
  Gene Symbol: CD37
  Gene Name: CD37 molecule
  ENST ID: ENST00000597602
  CDS Start-End: 251-330
tcagcctctttctttctccctgtctcccccactgtcagcacctcttctgtgtggtgagtggaccgcttaccccactaggtgaagatgtcagcccaggagagctgcctcagcctcatcaagtcctcggcagcctgatcttctgcttcggcatctggatcctcattgacaagaccagcttcgtgtcctttgcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgct

SEQ ID NO: 115577 - DNA, 1121 bp, Homo sapiens
  Payload ID: 2555
  Gene Symbol: CD37
  Gene Name: CD37 molecule
  ENST ID: ENST00000595725
  CDS Start-End: 142-507
aacttcctcttttggggttcttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcattgacaagaccagcttcgtgtcctttgcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgc

SEQ ID NO: 115578 - DNA, 5668 bp, Homo sapiens
  Payload ID: 2556
  Gene Symbol: CD38
  Gene Name: CD38 molecule
  Uniprot ID: P28907
  ENST ID: ENST00000226279
  CDS Start-End: 138-1040
gggggtgggaagggaaacagagaaaaggcaagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgagacatgtagactgccaaagtgtatgggatgctttcaagggtgcatttatttcaaaacatccttgcaacattactgaagaagactatcagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtggtgaattcaacacttccaaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctgagccagtcgctgtggttgttttagctccttgactccttgtggtttatgtcatcatacatgactcagcatacctgctggtgcagagctgaagattttggagggtcctccacaataaggtcaatgccagagacggaagcctttttccccaaagtcttaaaataacttatatcatcagcatacctttattgtgatctatcaatagtcaagaaaaattattgtataagattagaatgaaaattgtatgttaagttacttcactttaattctcatgtgatccttttatgttatttatatattggtaacatcctttctattgaaaaatcaccacaccaaacctctcttattagaacaggcaagtgaagaaaagtgaatgctcaagtttttcagaaagcattacatttccaaatgaatgaccttgttgcatgatgtatttttgtacccttcctacagatagtcaaaccataaacttcatggtcatgggtcatgttggtgaaaattattctgtaggatataagctacccacgtacttggtgctttaccccaacccttccaacagtgctgtgaggttggtattatttcattttttagatgagaaaatgggagctcagagaggttatatatttaagttggtgcaaaagtaattgcaagttttgccaccgaaaggaatggcaaaaccacaattatttttgaaccaacctaataatttaccgtaagtcctacatttagtatcaagctagagactgaatttgaactcaactctgtccaactccaaaattcatgtgctttttccttctaggcctttcataccaaactaatagtagtttatattctcttccaacaaatgcatattggattaaattgactagaatggaatctggaatatagttcttctggatggctccaaaacacatgtttttcttcccccgtcttcctcctcctcttcatgctcagtgttttatatatgtagtatacagttaaaatatacttgttgctggtactggcagcttatattttctctcttttttcatggattaaccttgcttgagggctttaacaattgtattactttttcaaagaactaagctttagcttcattgatttttttctatttaattgggttttgctcttctctttagcattggaaacatagaaatgctttctgatttctttgggtagatttacgtattcagcttcttgagatggaagtttagatcactgatccttcagcttgttttcttttttgtatacatagattttaggacgatatattttcccttgagttctgctttagctgcagctcttatgttttgatatgcctctctttattatccttcagttaaaaatatctttcaattcattgttatataaaaatatgtgcctagtttttaacatctggagattttctagttttgaaaaaaacataagccaggcatggtggctcacacctgtatccccagcactttgggaggccgagacgggaggatcgcctgagctcaggagtttttacaccagcctgggaataacagtgagacattatctccaaaaaaattacctgggtatggtgttgtgcacctgtagtcccagctactctggagactgaggtgggaggattgtttgagcttgggaggttgaggctgcagggagctgtgatcacaccactgcactctggcctgagtgacagattgagaccctgtctcaataaaagcaaaaataaagaaaataaaccatatgtgttgaacaaaggattaataaattaatttgagactccttcagggaatgaccacaatttattgaaaatagcctaaatgttggagtcaggcatttctggattcatattttgacatcatgctgtcatcttgaacaaaatgcctaacctttctgaacttcaacttccttgccactcaaataaggattacaaaacttaaaatgtggtaagtactaaagacgacagcaaaaattgagtccagcacagagcttcctaaataagcaagcactcaacagagttggttcctttcttcctcccctgcttgacaatccagtttcccacaggagcctttgtagctgtagccaccatggtcagtccagggattcttcactagccccttctcccctggcagacatccttgtgggagtttagtcttggctcgacatgaggatgggggtttgggaccagttctgagtgagaatcagacttgccccaagttgccattagctccccctgcagaatgtcttcagaatcggggcccggtcagtctcctgggtgacctgctgttttcctcttaagatcctttccactttggttgctgctttcgggactcatcgagtccttgctcaacaggataccccttgaagtggctgcctgggccacatccccttccaaacaagaaatcaaaatattagaaatcaatttttgaaatttcccctaggaagactcatttgagtgttcaagttcagagccagtggagaccttaggggagggtggtcacaaggattttgcacagtgctttagagggtcccagggagccacagaggtggtgaggggctgggtgctcttttctccgtgcatgaccttgtgtgtctatcttcattaccacaatgcctcatctctacctcctttccccctgtagttccaacgtgggtatctttgccatctctggcccgaaggactttctgacctacatgtataaataccccctcacaatatatattacttttcctataagtgacttctctactggattactggttgctcatacacctcatattttactcgtaaatctactactccctgtctgcctactccattctcatttgctgtagaaaattctcttaccatcccaactttcacccaccatcatgcttacccaaaggctgtgggaatgacctgggccctaatgccccttttctaaattcctaaggctcaccattttcctattgtaatggttcttgaccttataatgtttgaggcaccttttcaaatatagtcctttgatttcagactgaatacttgaaaggacacacacacacatacgtaagtgcatatgactgcatacacccacacacacacacgtgcctgtatacagtcatatgatacatacacaaacacacgcacacaagcctgcatacatcatatgccaacagtggggatatgttctgagaaatgcatcattagatgattttgtcattgtgtgaacatcatagagtgtacttacactaacctagatggtctaacctactacacacccaggctacatggtatcacctattcctcctaggctacaagcctgtacagcgtgtgtctgtactaaatgctgtgggcaattttaacctgatggtaaatgtttgtgtatctaaacatatctaaacatagaaaaggtacagtaaacatgcagtattataatcttatgagaccgtcatcatatatgtggtccactgtttgggccatcattggctgaaaagtggttatgcgacacatgactgtatatatactttcctgttacaacaacagtgtctctcaatccacagtaattgcagcatccagtaggtcttactttagccctgagtcaccatttgtgtcaacgtgtttagtgccatgtccacgtctctcatgtaactggcagagctatcaaatattttggcaaaacacattgtttctttggctttgccttggtaactttctgtgccttttgtagctcttgtttggaagaagctcaacccatgtctgcacactgtgatacaagggggacagcatcgacatcgacttacttcttggtgccttattcctccttagaacaattcctaaatctgtaacttaagtttctcaggaagattccatactgcacagaaaactgcttttgtgggtttttaaaaggcaagttgttatatgtgctggatagtttttaagtatgacataaaaattgtataaagtaaaatattaaaatacacctagaatactgtataactttaagtcattttatcaacacattgctaatccagatattttcccgcagtttttctttgaataacagagcaattaatttacttttactatgaagagtcatcattttagtatgtattttaagcaatccaccaagaactcagtaggcagctgagaggtgctgcccagagaagtggtgattagcttggccttagctcacccacacaaagcacaacaggctttgaactattccctaacggggcatttattcttttttttttttttttttgggagacggagtctcgctgtcgcccaggctagagtgcagtggcgcgatctcggctcactgcaggctccaccccctggggttcacgccattctcctgcctcagcctcccaagtagctgggactgcaggcgcccgccatctcgcccggctaattttttgtatttttagtagagacggggtttcaccgtgttagccaggatagggcatttattcttgaacttgattcagagaggcacacattaccattctctaatcagaatgcaagtagcgcaaggcggtggaaactatggaattcggaggcaggtgatgcattgggcgagtttattaacatctgtgactctctagtttgaaatttatttgtaacagacaaaaatgaattaaacaaacaataaaagtataataaag

SEQ ID NO: 115579 - DNA, 455 bp, Homo sapiens
  Payload ID: 2556
  Gene Symbol: CD38
  Gene Name: CD38 molecule
  ENST ID: ENST00000510674
  CDS Start-End: 1-455
cagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtgaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatc

SEQ ID NO: 115580 - DNA, 1560 bp, Homo sapiens
  Payload ID: 2556
  Gene Symbol: CD38
  Gene Name: CD38 molecule
  Uniprot ID: P28907
  ENST ID: ENST00000502843
  CDS Start-End: 141-509
gttgggggtgggaagggaaacagagaaaaggcaagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgagacatgtagactgccaaagtgtatgggatgctttcaagggtgcatttatttcaaaacatccttgcaacattactgaagaagactatcagccactaatgaagttgggaactcagaccgtaccttgcaacaagaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctgagccagtcgctgtggttgttttagctccttgactccttgtggtttatgtcatcatacatgactcagcatacctgctggtgcagagctgaagattttggagggtcctccacaataaggtcaatgccagagacggaagcctttttccccaaagtcttaaaataacttatatcatcagcatacctttattgtgatctatcaatagtcaagaaaaattattgtataagattagaatgaaaattgtatgttaagttacttcactttaattctcatgtgatccttttatgttatttatatattggtaacatcctttctattgaaaaatcaccacaccaaacctctcttattagaacaggcaagtgaagaaaagtgaatgctcaagtttttcagaaagcattacatttccaaatgaatgaccttgttgcatgatgtatttttgtacccttcctacagatagtcaaaccataaacttcatggtcatgggtcatgttggtgaaaattattctgtaggatataagctacccacgtacttggtgctttaccccaacccttccaacagtgctgtgaggttggtattatttcattttttagatgagaaaatgggagctcagagaggttatatatttaagttggtgcaaaagtaattgcaagttttgc

SEQ ID NO: 115581 - DNA, 861 bp, Homo sapiens
  Payload ID: 2557
  Gene Symbol: CD3D
  Gene Name: CD3d molecule, delta (CD3-TCR complex)
  Uniprot ID: P04234
  ENST ID: ENST00000300692
  CDS Start-End: 138-653
agagaagcagacatcttctagttcctcccccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcagcaggtgcctgggcttcttaaggctcctgggcaaggcgtgggagttgtcctgacttgcttgggatctcgccctcctacctacctgtttcttccttcatctccttccttcctctgcctcaca

SEQ ID NO: 115582 - DNA, 476 bp, Homo sapiens
  Payload ID: 2557
  Gene Symbol: CD3D
  Gene Name: CD3d molecule, delta (CD3-TCR complex)
  Uniprot ID: P04234
  ENST ID: ENST00000392884
  CDS Start-End: 25-408
ctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaactgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataa

SEQ ID NO: 115583 - DNA, 483 bp, Homo sapiens
  Payload ID: 2557
  Gene Symbol: CD3D
  Gene Name: CD3d molecule, delta (CD3-TCR complex)
  ENST ID: ENST00000534687
  CDS Start-End: 1-397
ttccaggtgcttcagtggtccgtgctccccctactcctcatcagtggtctggattcatttccaggaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaactgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactc

SEQ ID NO: 115584 - DNA, 422 bp, Homo sapiens
  Payload ID: 2557
  Gene Symbol: CD3D
  Gene Name: CD3d molecule, delta (CD3-TCR complex)
  ENST ID: ENST00000529594
  CDS Start-End: 41-337
ggtgacctggctttatctactggatgagttccgctgggagatggaacatagcacgtttctctctggcctggtactggctacccttctctcgcaagtgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcact

SEQ ID NO: 115585 - DNA, 1548 bp, Homo sapiens
  Payload ID: 2558
  Gene Symbol: CD3E
  Gene Name: CD3e molecule, epsilon (CD3-TCR complex)
  Uniprot ID: P07766
  ENST ID: ENST00000361763
  CDS Start-End: 292-915
gctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaaga

SEQ ID NO: 115586 - DNA, 1289 bp, Homo sapiens
  Payload ID: 2558
  Gene Symbol: CD3E
  Gene Name: CD3e molecule, epsilon (CD3-TCR complex)
  ENST ID: ENST00000528600
  CDS Start-End: 55-660
gtaagtctgctggcctccgccatcttagtaaagtaacagtcccatgaaacaaagatgcagtcgggcactcactggagagttctgggcctctgcctcttatcagttggcgtttgggggcaagatggtaatgaagaaatggcatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgc

SEQ ID NO: 115587 - DNA, 3286 bp, Homo sapiens
  Payload ID: 2559
  Gene Symbol: CD3EAP
  Gene Name: CD3e molecule, epsilon associated protein
  Uniprot ID: O15446
  ENST ID: ENST00000309424
  CDS Start-End: 489-2021
aagttctgaacttgtgaggcatctgggcctccccagaagacatttaacacagaaagcacagccctactaactagtattcttacctgtctcttcaagaatttcagaccaatcgaccgtcctgtctctttaaggcttaggaagagcagtgtggctgcccctttaaggaggcgttgcaacaaaccatattggacagacgatgggggcgacccatcgggacccgacgggcctctgactccagcaatacagcgaatcagcggctttcgggaatacatttttcggaaaaagacttcttcctcggttttctgctctgcacacgttgaaattttccccagtttttcctgcagatcgggagtcgagcaatgcctacccccgcgctcccgcaccagttgggcgctcccggatgatgccctacccctttggatccacgtggtctgcaacctggtgcgagcagcccgggctacagggttgcctgaggtgtgggtcccaggatggaggagccccaggccggcgatgctgctcggttctcttgtccccccaactttaccgcgaagcccccagcctcagagtcccctcgtttctccttggaggcgctgacgggtccagatacggagctgtggcttattcaggcccctgcagactttgccccagaatgcttcaatgggcggcatgtgcctctctctggctcccagatcgtcaagggcaaattggcaggcaagcggcaccgctatcgagtcctcagcagctgtccccaagctggagaagcgaccctgctggccccctcaacggaggcaggaggtggactcacctgtgcctcagccccccagggcaccctaaggatccttgagggtccccagcaatccctgtcagggagccctctgcagcccatcccagcaagtcccccaccacagatccctcctggcctgaggcctcggttctgtgcctttgggggcaacccaccagtcacagggcctaggtcagccttggcccccaacctgctcacctcagggaagaagaaaaaggagatgcaggtgacagaggccccagtcactcaggaggcagtgaatgggcacggggccctggaggtggacatggctttggggtcgccagaaatggatgtgcggaagaagaagaagaaaaaaaatcagcagctgaaagaaccagaggcagcagggcctgtggggacagagcccacagtggagacactggagcctctgggagtgctgttcccgtccaccaccaagaagaggaagaagcccaaagggaaagaaaccttcgagccagaagacaagacagtgaagcaggaacagattaacactgagcctctagaagacacagtcctgtccccgaccaaaaagagaaagaggcaaaaggggacggaagggatggagccagaggagggggtgacagttgagtctcagccacaggtgaaggtggagccactggaggaagccatccctctgccccctacgaagaagaggaaaaaagaaaagggacagatggcaatgatggagccagggacggaggcgatggagccagtggagccggagatgaagcctctggagtccccaggggggaccatggcgcctcaacagccagaaggagcgaagcctcaggcccaggcagctctggcagctcccaaaaagaagacgaagaaagaaaaacagcaagatgccacagtggagccagagacagaggtggtggggcctgagctgccggatgaccttgagcctcaggcagctcccacatccaccaagaagaagaagaagaagaaagagagaggtcacacagtgactgagccaattcagccactagagcctgaactgccaggggagggacagcctgaagccagggcaactccgggatccaccaagaagaggaagaagcagagtcaggaaagccggatgccagagacagtgccccaagaggagatgccagggccgccactgaattcagagtctggggaggaggctcccacaggccgggacaagaagcggaagcagcagcagcagcagcctgtgtagtctgcccccgggaaactgaggaactaaagaaagctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctcaagcatttatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattattatttttttgagacagtctcctggtgtcacccaggctggagtgcagtggtgtgatcttggctcactgcaacctccgcctcctgggttccaacgattctcctgcctcagcctcccgagtagctgggcctaaaggtgcccaccactatacccggctaatttttgtatttttagtagagacaggggtttcaccatattggccaggctggtctcgaactcctgacctcgtgatccacctgccttgacctcccaaagtgctaggataacaggtgtgagccaccgcaccctgccaagttattttaaaatgtaccattattattgactatagtcacctggttgtgttatcaaatagtatgtcttattcattctttctttgtgtgtgtgtgtgtgtgtgtgtgtgtgtgtggtacccattaaccttccccatctccctgccagcccctaactaccctccccagcctccaggaactatccatccactcttatctccatgagttcaattgttttgatttttagatacacaaataaataagaacatgcaatgtttgtctttctgtgcctggcttatttcactt

SEQ ID NO: 115588 - DNA, 1830 bp, Homo sapiens
  Payload ID: 2559
  Gene Symbol: CD3EAP
  Gene Name: CD3e molecule, epsilon associated protein
  Uniprot ID: O15446
  ENST ID: ENST00000589804
  CDS Start-End: 7-1545
cccaggatggaggagccccaggccggcggtgaggatgctgctcggttctcttgtccccccaactttaccgcgaagcccccagcctcagagtcccctcgtttctccttggaggcgctgacgggtccagatacggagctgtggcttattcaggcccctgcagactttgccccagaatgcttcaatgggcggcatgtgcctctctctggctcccagatcgtcaagggcaaattggcaggcaagcggcaccgctatcgagtcctcagcagctgtccccaagctggagaagcgaccctgctggccccctcaacggaggcaggaggtggactcacctgtgcctcagccccccagggcaccctaaggatccttgagggtccccagcaatccctgtcagggagccctctgcagcccatcccagcaagtcccccaccacagatccctcctggcctgaggcctcggttctgtgcctttgggggcaacccaccagtcacagggcctaggtcagccttggcccccaacctgctcacctcagggaagaagaaaaaggagatgcaggtgacagaggccccagtcactcaggaggcagtgaatgggcacggggccctggaggtggacatggctttggggtcgccagaaatggatgtgcggaagaagaagaagaaaaaaaatcagcagctgaaagaaccagaggcagcagggcctgtggggacagagcccacagtggagacactggagcctctgggagtgctgttcccgtccaccaccaagaagaggaagaagcccaaagggaaagaaaccttcgagccagaagacaagacagtgaagcaggaacagattaacactgagcctctagaagacacagtcctgtccccgaccaaaaagagaaagaggcaaaaggggacggaagggatggagccagaggagggggtgacagttgagtctcagccacaggtgaaggtggagccactggaggaagccatccctctgccccctacgaagaagaggaaaaaagaaaagggacagatggcaatgatggagccagggacggaggcgatggagccagtggagccggagatgaagcctctggagtccccaggggggaccatggcgcctcaacagccagaaggagcgaagcctcaggcccaggcagctctggcagctcccaaaaagaagacgaagaaagaaaaacagcaagatgccacagtggagccagagacagaggtggtggggcctgagctgccggatgaccttgagcctcaggcagctcccacatccaccaagaagaagaagaagaagaaagagagaggtcacacagtgactgagccaattcagccactagagcctgaactgccaggggagggacagcctgaagccagggcaactccgggatccaccaagaagaggaagaagcagagtcaggaaagccggatgccagagacagtgccccaagaggagatgccagggccgccactgaattcagagtctggggaggaggctcccacaggccgggacaagaagcggaagcagcagcagcagcagcctgtgtagtctgcccccgggaaactgaggaactaaagaaagctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaa

SEQ ID NO: 115589 - DNA, 489 bp, Homo sapiens
  Payload ID: 2559
  Gene Symbol: CD3EAP
  Gene Name: CD3e molecule, epsilon associated protein
  ENST ID: ENST00000590794
  CDS Start-End: 1-202
ggaggagccccaggccggcgcttcaatgggcggcatgtgcctctctctggctcccagatcgtcaagggcaaattggcaggcaagcggcaccgctatcgagtcctcagcagctgtccccaagctggagaagcgaccctgctggccccctcaacggaggcaggaggtggactcacctgtgcctcagccccccagggcaccctaaggatccttgagggtccccagcaatccctgtcagggagccctctgcagcccatcccagcaagtcccccaccacagatccctcctggcctgaggcctcggttctgtgcctttgggggcaacccaccagtcacagggcctaggtcagccttggcccccaacctgctcacctcagggaagaagaaaaaggagatgcaggtgacagaggccccagtcactcaggaggcagtgaatgggcacggggccctggaggtggacatggctttggggtcgccagaaatggatgtgcgg

SEQ ID NO: 115590 - DNA, 1061 bp, Homo sapiens
  Payload ID: 2559
  Gene Symbol: CD3EAP
  Gene Name: CD3e molecule, epsilon associated protein
  ENST ID: ENST00000592852
  CDS Start-End: 945-1061
cgggctacagggttgcctgaggtgtgggtcccaggatggaggagccccaggccggcggtgagggtgcgggttgacggggtgcggagggtgcgttggtggaaggagaaaggggcgtccgagagggttcgggcggaaaaggaggcgtacctgcaagcaggacttgcgaagagcgtgcattcccagtgggcgaacgggaattcgaacggagagagggttatcttgtggggggctacccgtggagagcaaggcgcccccaggggttggatcggtgaaattgaggtcgcccctggggaacaggtgggcagaaaggagaaaccaggttgaggggactggagtgctcacgaggttaagaccaatggaccgataggcgcgccctgcaagattggaccggcaaggaggtgtcagtcgaccccatttccccttctgctgcagatgctgctcggttctcttgtccccccaactttaccgcgaagcccccagcctcagagtcccctcgtttctccttggaggcgctgacgggtccagatacggagctgtggcttattcaggcccctgcagactttgccccagaatgcttcaatgggcggcatgtgcctctctctggctcccagatcgtcaagggcaaattggcaggcaagcggcaccgctatcgagtcctcagcagctgtccccaagctggagaagcgaccctgctggccccctcaacggaggcaggaggtggactcacctgtgcctcagccccccagggcaccctaaggatccttgagggtccccagcaatccctgtcagggagccctctgcagcccatcccagcaagtcccccaccacagatccctcctggcctgaggcctcggttctgtgcctttgggggcaacccaccagtcacagggcctaggtcagccttggcccccaacctgctcacctcagggaagaagaaaaaggagatgcaggtgacagaggccccagtcactcaggaggcagtgaatgggcacggggccctggaggtggacatggctttggggtcgccagaaatggatgtgcggaagaagaagaagaaaaaa

SEQ ID NO: 115591 - DNA, 1525 bp, Homo sapiens
  Payload ID: 2560
  Gene Symbol: CD3G
  Gene Name: CD3g molecule, gamma (CD3-TCR complex)
  ENST ID: ENST00000292144
  CDS Start-End: 60-182
ggctggctggctggctgctaagggctgctccacgcttttgccggaggacagagactgacatggaacaggggaagggcctggctgtcctcatcctggctatcattcttcttcaaggtactttggcccagtcaatcaaaggtaggagaaatggcttctttctatactcagactcagaatattgacggaaatttggcttcctacaacagtagtcctacaggagcgaacagtttagaatgaatgaaatgacggggatagagaggagaagcaggaccctagtagctagggacacatctcaaactgtgacccatgaaccagtaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgtaaaagaaaaatgaaaagatcaaataaccccctggatttgaatataattttttgtgttgtaatttttatttcgtttttgtataggttataattcacatggctcaaatattcagtgaaagctctccctccaccgccatcccctgctacccagtgaccctgttgccctcttcagagacaaattagtttctcttttttttttttttttttttttttttgagacagtctggctctgtcacccaggctgaaatgcagtggcaccatctcggctcactgcaacctctgcctcctgggttcaagcgattctcctgcctcagcctcccgggcagctgggattacaggcacacactaccacacctggctaatttttgtatttttagtagagacagggttttgctctgttggccaagctggtctcgaactcctgacctcaagtgatccgcccgcctcagcctcccaaagtgctgggattacaggtgtgagccaccatgcctggtcttaaaac

SEQ ID NO: 115592 - DNA, 1179 bp, Homo sapiens
  Payload ID: 2560
  Gene Symbol: CD3G
  Gene Name: CD3g molecule, gamma (CD3-TCR complex)
  ENST ID: ENST00000392883
  CDS Start-End: 261-497
agtctagctgctgcacaggctggctggctggctggctgctaagggctgctccacgcttttgccggaggacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaacttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgtaaaagaaaaatgaaaagatcaaataaccccctggatttgaatataattttttgtgttgtaatttttatttcgtttttgtataggttataattcacatggctcaaatattcagtgaaagctctccctccaccgccatcccctgctacccagtgaccctgttgccctcttcagagacaaattagtttctcttttttttttttttttttttttttttgagacagtctggctctgtcacccaggctgaaatgcagtggcaccatctcggctcactgcaacctctgcctcctgggttcaagcgattctcctgcctcagcctcccgggcagctgggattacaggcacacactaccacacctggctaatttttgtatttttagtagagacagggttttgctctgttggccaagctggtctcgaactcctgacctcaagtgatccgcccgcctc

SEQ ID NO: 115593 - DNA, 2678 bp, Homo sapiens
  Payload ID: 2560
  Gene Symbol: CD3G
  Gene Name: CD3g molecule, gamma (CD3-TCR complex)
  Uniprot ID: P09693
  ENST ID: ENST00000532917
  CDS Start-End: 69-617
gcacaggctggctggctggctggctgctaagggctgctccacgcttttgccggaggacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgtaaaagaaaaatgaaaagatcaaataaccccctggatttgaatataattttttgtgttgtaatttttatttcgtttttgtataggttataattcacatggctcaaatattcagtgaaagctctccctccaccgccatcccctgctacccagtgaccctgttgccctcttcagagacaaattagtttctcttttttttttttttttttttttttttgagacagtctggctctgtcacccaggctgaaatgcagtggcaccatctcggctcactgcaacctctgcctcctgggttcaagcgattctcctgcctcagcctcccgggcagctgggattacaggcacacactaccacacctggctaatttttgtatttttagtagagacagggttttgctctgttggccaagctggtctcgaactcctgacctcaagtgatccgcccgcctcagcctcccaaagtgctgggattacaggtgtgagccaccatgcctggtcttaaaaccagtttcttatatatctctctggaggtattctaggcatatatgagcacattctcaagtacatattatcctcccttcccctatcttttagacaaatgatatcaaactatacatcttgtgagattattgcataccattatatgaagataccattatatcctttttaatgcaaccatattgtacaaatagactatgatttatttaacctgttatctatcagtggatatttaagttggtagttggttccaatcttttgctcttacaacaattctgcaatgactaacattgtataaatatcatttttaaaaataattgcattgaagcataatgtacatgccataaaatccacccatcttaagtgatttcacctgttctcagaaatttttagtaaatttaactaattgtacagccattaccataatccagctttaggacattttcttttttttcttttcttttcttttttttcttttttttttttttttgaagtggaatcttgctctgtggcccaggctggagtgcagtggcgcgatctcagctcactgcaacctccacctcctgggttcaagcgattctcttgccttggcctcccgagtagctgagactacaggcacatgccaccacgcccagctcattttttgtgtatttagtatttgtgtatctagtatttgtgtacttagtagagacagggtttcaccatgttggccaggctggtctccaattcctgacctcaggcgatccacccgccttgacctcccaaagtgctgggattacaggtgtgagccaccgcgccaggcccgtaactgtattttaatatagccattctatggatttaatatggtattttattatggccttaatttgcatttccctagatactaaccatgctgagtgtcctgtcttgtgtttattaaccattcatatatttttagtgaaatgtgtatcaaatcttttgcccatttttaagttgacttatttgtttgtcttcttactattgggttgcatatgtttttgatataagtcctttatcagatatatgatttggaaatattttctaccaatctgtggtttgtttttcttaatggtgtcttttgaagtgcaaaaggtttgaattttgaagtacattttattgattttttcttctatatattgtgcttttggtatcatgtctaataaatctttaccaaacccacagttacaaagattttctcctgtcttctttttatactttttacagctttatggttttagctctaacaataaatgtgattttgaacatacataagactatttgtaacaaacacaaataaattgaattgttgggca

SEQ ID NO: 115594 - DNA, 3114 bp, Homo sapiens
  Payload ID: 2561
  Gene Symbol: CD4
  Gene Name: CD4 molecule
  Uniprot ID: P01730
  ENST ID: ENST00000011653
  CDS Start-End: 259-1635
gtttggggccggcccaggcctagggtgtggaggagccttgccatcgggcttcctgtctctcttcatttaagcacgactctgcagaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaactttcccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagagactcctcagtgagaagaagacctgccagtgtcctcaccggtttcagaagacatgtagccccatttgaggcacgaggccaggcagatcccacttgcagcctccccaggtgtctgccccgcgtttcctgcctgcggaccagatgaatgtagcagatccccagcctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcccaggggagtgttcagggccagccctggctggcatggagggtgaggctgggtgtctggaagcatggagcatgggactgttcttttacaagacaggaccctgggaccacagagggcaggaacttgcacaaaatcacacagccaagccagtcaaggatggatgcagatccagaggtttctggcagccagtacctcctgccccatgctgcccgcttctcaccctatgtgggtgggaccacagactcacatcctgaccttgcacaaacagcccctctggacacagccccatgtacacggcctcaagggatgtctcacatcctctgtctatttgagacttagaaaaatcctacaaggctggcagtgacagaactaagatgatcatctccagtttatagaccagaaccagagctcagagaggctagatgattgattaccaagtgccggactagcaagtgctggagtcgggactaacccaggtcccttgtcccaagttccactgctgcctcttgaatgcagggacaaatgccacacggctctcaccagtggctagtggtgggtactcaatgtgtacttttgggttcacagaagcacagcacccatgggaagggtccatctcagagaatttacgagcagggatgaaggcctccctgtctaaaatccctccttcatcccccgctggtggcagaatctgttaccagaggacaaagcctttggctcttctaatcagagcgcaagctgggagcacaggcactgcaggagagaatgcccagtgaccagtcactgaccctgtgcagaacctcctggaagcgagctttgctgggagagggggtagctagcctgagagggaaccctctaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaataaaaatacaataaacttactataaagat

SEQ ID NO: 115595 - DNA, 579 bp, Homo sapiens
  Payload ID: 2561
  Gene Symbol: CD4
  Gene Name: CD4 molecule
  ENST ID: ENST00000539492
  CDS Start-End: 444-579
accctccccactgggctcctggttgcagagctccaagtcctcacacagatacgcctgtttgagaagcagcgggcaagaaagacgcaagcccagagaaaatcctctgctggctctctagtgcccaggatccagtcccagcatctcagcacggccttcaagcatttccacgtcctggcctggctccatggtctccccgccaatttgccaccttctccatgcatccttttctgatcccctcctcactcatcccagcaaagaaccccctcctggcctgagcatagcatttcgtgtggtgcaatcttggctcactgcaacctcctcctccctggttcaagtgattctcctgcctcagcttcctaagcacctgagactacaggccctgccatttctgtgggctcaggtccctactggctcaggcccctgcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccaga

SEQ ID NO: 115596 - DNA, 1187 bp, Homo sapiens
  Payload ID: 2561
  Gene Symbol: CD4
  Gene Name: CD4 molecule
  ENST ID: ENST00000541982
  CDS Start-End: 195-641
atttaagcacgactctgcagaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacaatgaaccggggagtcccttttaggcacttgcttctggtgctgcaactgggtccatccaagctgaatgatcgcgctgactcaagaagaagcctttgggaccaaggaaactttcccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagggtgatgaatacgcctctaaggagtggaggccaaatggcttctgtggtccaggaatcctaaggacagcaaggatcccctgtggctgggctgctctgtgatggcttccgggaggagggaggtggcctgctgtaggaaaatgctgggtggaagaagggagagaaggctggagaggtaggaaggaactgaagtatctgaagtgacaaggtgggtgtctggactcgtcgggtccccttccatctccctgctgcctccacatgccaaccccactcgtgcaccctcatcttcctatctcctcacccagggtctctcccttcccacctccagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagct

SEQ ID NO: 115597 - DNA, 1720 bp, Homo sapiens
  Payload ID: 2562
  Gene Symbol: CD40LG
  Gene Name: CD40 ligand
  ENST ID: ENST00000370628
  CDS Start-End: 23-745
accatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaagtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 115598 - DNA, 1817 bp, Homo sapiens
  Payload ID: 2562
  Gene Symbol: CD40LG
  Gene Name: CD40 ligand
  Uniprot ID: P29965
  ENST ID: ENST00000370629
  CDS Start-End: 57-842
catgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 115599 - DNA, 1623 bp, Homo sapiens
  Payload ID: 2563
  Gene Symbol: CD40
  Gene Name: CD40 molecule, TNF receptor superfamily member 5
  Uniprot ID: P25942
  ENST ID: ENST00000372276
  CDS Start-End: 29-640
tggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 115600 - DNA, 1729 bp, Homo sapiens
  Payload ID: 2563
  Gene Symbol: CD40
  Gene Name: CD40 molecule, TNF receptor superfamily member 5
  Uniprot ID: P25942
  ENST ID: ENST00000372285
  CDS Start-End: 73-906
ggctggggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 115601 - DNA, 822 bp, Homo sapiens
  Payload ID: 2563
  Gene Symbol: CD40
  Gene Name: CD40 molecule, TNF receptor superfamily member 5
  ENST ID: ENST00000466205
  CDS Start-End: 1-479
ttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgaggg

SEQ ID NO: 115602 - DNA, 1522 bp, Homo sapiens
  Payload ID: 2563
  Gene Symbol: CD40
  Gene Name: CD40 molecule, TNF receptor superfamily member 5
  ENST ID: ENST00000620709
  CDS Start-End: 67-522
ggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattg

SEQ ID NO: 115603 - DNA, 4589 bp, Homo sapiens
  Payload ID: 2564
  Gene Symbol: CD44
  Gene Name: CD44 molecule (Indian blood group)
  Uniprot ID: P16070
  ENST ID: ENST00000263398
  CDS Start-End: 435-1520
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 115604 - DNA, 697 bp, Homo sapiens
  Payload ID: 2564
  Gene Symbol: CD44
  Gene Name: CD44 molecule (Indian blood group)
  ENST ID: ENST00000278385
  CDS Start-End: 1-697
cctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtga

SEQ ID NO: 115605 - DNA, 484 bp, Homo sapiens
  Payload ID: 2564
  Gene Symbol: CD44
  Gene Name: CD44 molecule (Indian blood group)
  Uniprot ID: P16070
  ENST ID: ENST00000278386
  CDS Start-End: 19-438
ccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaa

SEQ ID NO: 115606 - DNA, 862 bp, Homo sapiens
  Payload ID: 2564
  Gene Symbol: CD44
  Gene Name: CD44 molecule (Indian blood group)
  ENST ID: ENST00000279452
  CDS Start-End: 1-862
cgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaaga

SEQ ID NO: 115607 - DNA, 1023 bp, Homo sapiens
  Payload ID: 2564
  Gene Symbol: CD44
  Gene Name: CD44 molecule (Indian blood group)
  Uniprot ID: P16070
  ENST ID: ENST00000352818
  CDS Start-End: 1-1023
atggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaa

SEQ ID NO: 115608 - DNA, 2369 bp, Homo sapiens
  Payload ID: 2564
  Gene Symbol: CD44
  Gene Name: CD44 molecule (Indian blood group)
  Uniprot ID: P16070
  ENST ID: ENST00000415148
  CDS Start-End: 135-2234
cctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctt

SEQ ID NO: 115609 - DNA, 2292 bp, Homo sapiens
  Payload ID: 2564
  Gene Symbol: CD44
  Gene Name: CD44 molecule (Indian blood group)
  Uniprot ID: P16070
  ENST ID: ENST00000433892
  CDS Start-End: 117-1598
cccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttca

SEQ ID NO: 115610 - DNA, 1768 bp, Homo sapiens
  Payload ID: 2564
  Gene Symbol: CD44
  Gene Name: CD44 molecule (Indian blood group)
  ENST ID: ENST00000425428
  CDS Start-End: 123-365
gcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttca

SEQ ID NO: 115611 - DNA, 1825 bp, Homo sapiens
  Payload ID: 2564
  Gene Symbol: CD44
  Gene Name: CD44 molecule (Indian blood group)
  ENST ID: ENST00000442151
  CDS Start-End: 1-883
ggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaagttgaagagattcaggttatagcataagaagagcactgtttcatcgtcttcttgctgttaggaggtctatgaagcagagaagaactttcctttggaaaacaactaaatgaagacagtcacctcgctagaactgacacatgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagacctagagagaattatggactccttactggtttttggaaagcaaccaacagctaattccaacaccatgggcagcccatacagtctctaattatctgagaaaatcaaatgatgctgttacaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcct

SEQ ID NO: 115612 - DNA, 3046 bp, Homo sapiens
  Payload ID: 2564
  Gene Symbol: CD44
  Gene Name: CD44 molecule (Indian blood group)
  Uniprot ID: P16070
  ENST ID: ENST00000428726
  CDS Start-End: 124-2352
agcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttca

SEQ ID NO: 115613 - DNA, 1634 bp, Homo sapiens
  Payload ID: 2564
  Gene Symbol: CD44
  Gene Name: CD44 molecule (Indian blood group)
  Uniprot ID: P16070
  ENST ID: ENST00000434472
  CDS Start-End: 12-1301
ctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttc

SEQ ID NO: 115614 - DNA, 586 bp, Homo sapiens
  Payload ID: 2564
  Gene Symbol: CD44
  Gene Name: CD44 molecule (Indian blood group)
  ENST ID: ENST00000528672
  CDS Start-End: 1-586
agaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactg

SEQ ID NO: 115615 - DNA, 747 bp, Homo sapiens
  Payload ID: 2564
  Gene Symbol: CD44
  Gene Name: CD44 molecule (Indian blood group)
  ENST ID: ENST00000525211
  CDS Start-End: 1-747
atagatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccacagcctcagctcataccagccatccaatgcaaggaaggacaacaccaagcccagaggacagttcctggactgatttcttcaacccaatctcacaccccatgggacgaggtcatcaagcaggaagaaggatgggtaatagcctc

SEQ ID NO: 115616 - DNA, 870 bp, Homo sapiens
  Payload ID: 2564
  Gene Symbol: CD44
  Gene Name: CD44 molecule (Indian blood group)
  ENST ID: ENST00000526669
  CDS Start-End: 123-743
gcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaatttt

SEQ ID NO: 115617 - DNA, 687 bp, Homo sapiens
  Payload ID: 2564
  Gene Symbol: CD44
  Gene Name: CD44 molecule (Indian blood group)
  ENST ID: ENST00000528455
  CDS Start-End: 1-687
ccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagac

SEQ ID NO: 115618 - DNA, 584 bp, Homo sapiens
  Payload ID: 2564
  Gene Symbol: CD44
  Gene Name: CD44 molecule (Indian blood group)
  ENST ID: ENST00000531873
  CDS Start-End: 1-584
ggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactg

SEQ ID NO: 115619 - DNA, 571 bp, Homo sapiens
  Payload ID: 2564
  Gene Symbol: CD44
  Gene Name: CD44 molecule (Indian blood group)
  ENST ID: ENST00000526553
  CDS Start-End: 1-571
ttcaaccacaccacgggcttttgaccacacaaaacagaaccaggactggacccagtggaacccaagccattcaaatccggaagtgctacttcagacaaccacaaggatgactgtccaggcaactcctagtagtacaacggaagaaacagctacccagaaggaacagtggtttggcaacagatggcatgagggatatcgccaaacacccaaagaagactcccattcgacaacagggacagctgcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagtaaggat

SEQ ID NO: 115620 - DNA, 722 bp, Homo sapiens
  Payload ID: 2564
  Gene Symbol: CD44
  Gene Name: CD44 molecule (Indian blood group)
  ENST ID: ENST00000526000
  CDS Start-End: 1-722
gatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaaga

SEQ ID NO: 115621 - DNA, 543 bp, Homo sapiens
  Payload ID: 2564
  Gene Symbol: CD44
  Gene Name: CD44 molecule (Indian blood group)
  ENST ID: ENST00000527889
  CDS Start-End: 1-543
ctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggagatatggactccagtcatagtataacgcttcagcctactgcaaatccaaacacaggtttggtggaagatttggacaggacaggacctctttcaatgacaacgc

SEQ ID NO: 115622 - DNA, 705 bp, Homo sapiens
  Payload ID: 2564
  Gene Symbol: CD44
  Gene Name: CD44 molecule (Indian blood group)
  ENST ID: ENST00000525469
  CDS Start-End: 1-249
agcaaacacaacctctggtcctataaggacaccccaaattccaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggg

SEQ ID NO: 115623 - DNA, 581 bp, Homo sapiens
  Payload ID: 2564
  Gene Symbol: CD44
  Gene Name: CD44 molecule (Indian blood group)
  ENST ID: ENST00000533222
  CDS Start-End: 1-581
atctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaa

SEQ ID NO: 115624 - DNA, 1052 bp, Homo sapiens
  Payload ID: 2564
  Gene Symbol: CD44
  Gene Name: CD44 molecule (Indian blood group)
  ENST ID: ENST00000526025
  CDS Start-End: 423-659
agtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtaagagaccagcacccgaccactggggaaagctggcggcctgggaccaggcagctgggcttagaactggaaggctcctttcccacagctgaatggattattgcctaaggagtcaaccccacgtattaatttggccaagtcaatctgcaacctgtatgacaactggagtttaaagtcagctaaagacacctttgtgaatcatagagcgggaacccagaggaagccattaggggtcctctcggctggaatcctcttgtctaacctgcttccacagagctctcctggctttgaagaagctgcagtatcattgtcagaaccacaagaaaacataaaccaaataacagtgtttgaaataaatatgtggctgttagagtcttggccctgcagacttggatca

SEQ ID NO: 115625 - DNA, 352 bp, Homo sapiens
  Payload ID: 2564
  Gene Symbol: CD44
  Gene Name: CD44 molecule (Indian blood group)
  ENST ID: ENST00000524922
  CDS Start-End: 1-352
cccagacgaagacagtccctggatcaccgacagcacagacagaatccctgctaccagctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcat

SEQ ID NO: 115626 - DNA, 749 bp, Homo sapiens
  Payload ID: 2564
  Gene Symbol: CD44
  Gene Name: CD44 molecule (Indian blood group)
  ENST ID: ENST00000531110
  CDS Start-End: 1-749
gaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagtaagga

SEQ ID NO: 115627 - DNA, 728 bp, Homo sapiens
  Payload ID: 2564
  Gene Symbol: CD44
  Gene Name: CD44 molecule (Indian blood group)
  ENST ID: ENST00000525685
  CDS Start-End: 1-728
cagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagtaaggattat

SEQ ID NO: 115628 - DNA, 560 bp, Homo sapiens
  Payload ID: 2564
  Gene Symbol: CD44
  Gene Name: CD44 molecule (Indian blood group)
  ENST ID: ENST00000525688
  CDS Start-End: 1-560
agaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtgg

SEQ ID NO: 115629 - DNA, 3278 bp, Homo sapiens
  Payload ID: 2565
  Gene Symbol: CD46
  Gene Name: CD46 molecule, complement regulatory protein
  Uniprot ID: P15529
  ENST ID: ENST00000322875
  CDS Start-End: 157-1356
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 115630 - DNA, 3124 bp, Homo sapiens
  Payload ID: 2565
  Gene Symbol: CD46
  Gene Name: CD46 molecule, complement regulatory protein
  Uniprot ID: P15529
  ENST ID: ENST00000322918
  CDS Start-End: 157-1206
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccataggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 115631 - DNA, 3233 bp, Homo sapiens
  Payload ID: 2565
  Gene Symbol: CD46
  Gene Name: CD46 molecule, complement regulatory protein
  Uniprot ID: P15529
  ENST ID: ENST00000354848
  CDS Start-End: 157-1311
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 115632 - DNA, 3188 bp, Homo sapiens
  Payload ID: 2565
  Gene Symbol: CD46
  Gene Name: CD46 molecule, complement regulatory protein
  Uniprot ID: P15529
  ENST ID: ENST00000357714
  CDS Start-End: 157-1266
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 115633 - DNA, 3371 bp, Homo sapiens
  Payload ID: 2565
  Gene Symbol: CD46
  Gene Name: CD46 molecule, complement regulatory protein
  Uniprot ID: P15529
  ENST ID: ENST00000358170
  CDS Start-End: 157-1335
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 115634 - DNA, 3081 bp, Homo sapiens
  Payload ID: 2565
  Gene Symbol: CD46
  Gene Name: CD46 molecule, complement regulatory protein
  Uniprot ID: P15529
  ENST ID: ENST00000360212
  CDS Start-End: 99-1166
gcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggaga

SEQ ID NO: 115635 - DNA, 3281 bp, Homo sapiens
  Payload ID: 2565
  Gene Symbol: CD46
  Gene Name: CD46 molecule, complement regulatory protein
  Uniprot ID: P15529
  ENST ID: ENST00000367041
  CDS Start-End: 157-1245
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 115636 - DNA, 3326 bp, Homo sapiens
  Payload ID: 2565
  Gene Symbol: CD46
  Gene Name: CD46 molecule, complement regulatory protein
  Uniprot ID: P15529
  ENST ID: ENST00000367042
  CDS Start-End: 157-1290
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 115637 - DNA, 3089 bp, Homo sapiens
  Payload ID: 2565
  Gene Symbol: CD46
  Gene Name: CD46 molecule, complement regulatory protein
  Uniprot ID: P15529
  ENST ID: ENST00000367047
  CDS Start-End: 157-1167
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccggagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 115638 - DNA, 1258 bp, Homo sapiens
  Payload ID: 2565
  Gene Symbol: CD46
  Gene Name: CD46 molecule, complement regulatory protein
  Uniprot ID: P15529
  ENST ID: ENST00000480003
  CDS Start-End: 91-1203
tatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttca

SEQ ID NO: 115639 - DNA, 473 bp, Homo sapiens
  Payload ID: 2565
  Gene Symbol: CD46
  Gene Name: CD46 molecule, complement regulatory protein
  ENST ID: ENST00000462968
  CDS Start-End: 1-236
agcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctgtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagca

SEQ ID NO: 115640 - DNA, 5020 bp, Homo sapiens
  Payload ID: 2566
  Gene Symbol: CD47
  Gene Name: CD47 molecule
  Uniprot ID: Q08722
  ENST ID: ENST00000355354
  CDS Start-End: 118-1035
tgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 115641 - DNA, 1285 bp, Homo sapiens
  Payload ID: 2566
  Gene Symbol: CD47
  Gene Name: CD47 molecule
  Uniprot ID: Q08722
  ENST ID: ENST00000361309
  CDS Start-End: 107-1078
tcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatc

SEQ ID NO: 115642 - DNA, 469 bp, Homo sapiens
  Payload ID: 2566
  Gene Symbol: CD47
  Gene Name: CD47 molecule
  ENST ID: ENST00000398258
  CDS Start-End: 1-260
gttggactgagtctctgtattgcggcgtgtataccaatgcatggccctcttctgatttcaggtttgagtatcttagctctagcacaattacttggactagtttatatgaaatttgtggggttcagagggacacctacagtcagttgaaaggcaagaagagacaagcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatcta

SEQ ID NO: 115643 - DNA, 538 bp, Homo sapiens
  Payload ID: 2566
  Gene Symbol: CD47
  Gene Name: CD47 molecule
  ENST ID: ENST00000517766
  CDS Start-End: 1-329
taaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatcta

SEQ ID NO: 115644 - DNA, 1793 bp, Homo sapiens
  Payload ID: 2567
  Gene Symbol: CD48
  Gene Name: CD48 molecule
  Uniprot ID: P09326
  ENST ID: ENST00000368045
  CDS Start-End: 41-550
caactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttggtgagtcaggggagccaaagagcaaatccccactccagtggccccagatggaccactgtagggcttcctgggaggcatggggcactctcggggaggaggagagaaaaacctcaggacaggtttgattcatttttccttgatccaattctatttgggagtgagcctaggtcaacagatatccaaattaacaatcttaggacatttaacacctcttctgaagttagtgagtctaagctttgaagagaaggaaaactagagatttttcctatttccttcattttgtcctgtgatcaacctaaatcagctcagctcatcttgattatatctccgaaattaggcttcattggacttaagaaaaaagagaatgtattaatataaagaatggggcaggagttatcaggagaatttttcaactttcataatgggcaggacaaaaaaacttccactcatagctccagtctaaccagtgtatatggaataaggactcaggcattatacctggagccagacagacttgggttcaaaactggtcagttgctcactagctgtgcagccttgaaaaaagatcttcacatctctgtgcccatattaggtaagattcttttgatagcaaataacagaaactaattcaatgtacctttaccaaaaaaggagaatttagtttaagaaactagggctatttaaagcaattcaaagagtttaaaagagctaggaagggcttaaggggagaagattgaaaaccaggttcgggccagaacccctagcttcaggaatctgtggactgtgcctatggatttggattcctgccattttacacatgttatctctcaaaacttagacttttgctcctctgagtttcaattctcagggcaatttaaagagagagaaactgatagtcccaatttagttcaggtgtgtgtacctgatctaaacatttttggtgaaaggatcagattatagggcagaaacatggatatggggaggggctccaggggttggggtatgcaattcttgtagaagagcggggctaaataatccaagagtggtgttcccttgagagccttgggttcttcatcatattatgagaataattctacttacctttcaggatgttattagagtcaaagtagataaggaaagtgaaaacattttttaaaatgtcaaaacatgcaaatgaagagtgttgtatacattcaagttccaccagccagacagtccctgatccaagcagtcagattccccttctaactcttcttccatgtcatatgggctgaaaattcagaaagtcctgggaacaaaaagattcaaggtctcttacagtggtgttctggttaacaagctctacaagatttaaaaaaaaaaaaaaaa

SEQ ID NO: 115645 - DNA, 1126 bp, Homo sapiens
  Payload ID: 2567
  Gene Symbol: CD48
  Gene Name: CD48 molecule
  Uniprot ID: P09326
  ENST ID: ENST00000368046
  CDS Start-End: 89-820
gtttggtaagttccgtttttagccccggcctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattgtcaattaactgaa

SEQ ID NO: 115646 - DNA, 1500 bp, Homo sapiens
  Payload ID: 2567
  Gene Symbol: CD48
  Gene Name: CD48 molecule
  ENST ID: ENST00000613788
  CDS Start-End: 69-827
agccccggcctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctgggtaagaaggatccctgggagctgaggggggcacagggtaactggagttgttttgaacaaagaaaggctgggggtcctattcagcctccttgcacagtgtggtggtgaatccctaaggtgtctgggagagctgggagacgtgggttctgccaccagctctaccaccacctcccagccagcttacctcaacttcgtgggggctcagtgttctcacctgcaaaggacgtttgggagagatctctgatactcctcttccctctcccgctctaacaaagcatagtcctaacatctgaggccagggtcatcatagagtagactgaaacatcagggtgagcagggagaaggaagggcaagtgggcgagcagctgtctagaggggcttcattagacagccgaagtcagccaaggaaagagggaccgaggtcattagaccgccaaagtcagccagggaaagagggactgaggagacgggcctgagagaggccgtcgaggaggcgtgagagcctgagcctcaggcgaagcttctcctccccagcctgatgttcctagatgaacttaggaagccagattcccctgtctcctgggaggatccactcatgagtgtcacacctggctctagatcaggcctacactggtgctagcatgggacagctaaggccatgggttttagagtcagtcatacctggggtcacttctaggactgtcacttactagctaaacaagttacttagcttccccaagtcatgttcttcctaaataaaggacaaaataacagttcctat

SEQ ID NO: 115647 - DNA, 3221 bp, Homo sapiens
  Payload ID: 2568
  Gene Symbol: CD5
  Gene Name: CD5 molecule
  Uniprot ID: P06127
  ENST ID: ENST00000347785
  CDS Start-End: 167-1654
aacttcaaacatgggtgacgcaggccccacactgcctgctccccgtcccacccctccctgagcacgccaccccgccctctccctctctgagagcgagatacccggccagacaccctcacctgcggtgcccagctgcccaggctgaggcaagagaaggccagaaaccatgcccatggggtctctgcaaccgctggccaccttgtacctgctggggatgctggtcgcttcctgcctcggacggctcagctggtatgacccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttagaaccccagaagacaacacctccaacgacaaggcccccgcccaccacaactccagagcccacagctcctcccaggctgcagctggtggcacagtctggcggccagcactgtgccggcgtggtggagttctacagcggcagcctggggggtaccatcagctatgaggcccaggacaagacccaggacctggagaacttcctctgcaacaacctccagtgtggctccttcttgaagcatctgccagagactgaggcaggcagagcccaagacccaggggagccacgggaacaccagcccttgccaatccaatggaagatccagaactcaagctgtacctccctggagcattgcttcaggaaaatcaagccccagaaaagtggccgagttcttgccctcctttgctcaggtttccagcccaaggtgcagagccgtctggtggggggcagcagcatctgtgaaggcaccgtggaggtgcgccagggggctcagtgggcagccctgtgtgacagctcttcagccaggagctcgctgcggtgggaggaggtgtgccgggagcagcagtgtggcagcgtcaactcctatcgagtgctggacgctggtgacccaacatcccgggggctcttctgtccccatcagaagctgtcccagtgccacgaactttgggagagaaattcctactgcaagaaggtgtttgtcacatgccaggatccaaaccccgcaggcctggccgcaggcacggtggcaagcatcatcctggccctggtgctcctggtggtgctgctggtcgtgtgcggcccccttgcctacaagaagctagtgaagaaattccgccagaagaagcagcgccagtggattggcccaacgggaatgaaccaaaacatgtctttccatcgcaaccacacggcaaccgtccgatcccatgctgagaaccccacagcctcccacgtggataacgaatacagccaacctcccaggaactcccacctgtcagcttatccagctctggaaggggctctgcatcgctcctccatgcagcctgacaactcctccgacagtgactatgatctgcatggggctcagaggctgtaaagaactgggatccatgagcaaaaagccgagagccagacctgtttgtcctgagaaaactgtccgctcttcacttgaaatcatgtccctatttctaccccggccagaacatggacagaggccagaagccttccggacaggcgctgctgccccgagtggcaggccagctcacactctgctgcacaacagctcggccgcccctccacttgtggaagctgtggtgggcagagccccaaaacaagcagccttccaactagagactcgggggtgtctgaagggggccccctttccctgcccgctggggagcggcgtctcagtgaaatcggctttctcctcagactctgtccctggtaaggagtgacaaggaagctcacagctgggcgagtgcattttgaatagttttttgtaagtagtgcttttcctccttcctgacaaatcgagcgctttggcctcttctgtgcagcatccacccctgcggatccctctggggaggacaggaaggggactcccggagacctctgcagccgtggtggtcagaggctgctcacctgagcacaaagacagctctgcacattcaccgcagctgccagccaggggtctgggtgggcaccaccctgacccacagcgtcaccccactccctctgtcttatgactcccctccccaaccccctcatctaaagacaccttcctttccactggctgtcaagcccacagggcaccagtgccacccagggcccggcacaaaggggcgcctagtaaaccttaaccaacttggttttttgcttcacccagcaattaaaagtcccaagctgaggtagtttcagtccatcacagttcatcttctaacccaagagtcagagatggggctggtcatgttcctttggtttgaataactcccttgacgaaaacagactcctctagtacttggagatcttggacgtacacctaatcccatggggcctcggcttccttaactgcaagtgagaagaggaggtctacccaggagcctcgggtctgatcaagggagaggccaggcgcagctcactgcggcggctccctaagaaggtgaagcaacatgggaacacatcctaagacaggtcctttctccacgccatttgatgctgtatctcctgggagcacaggcatcaatggtccaagccgcataataagtctggaagagcaaaagggagttactaggatatggggtgggctgctcccagaatctgctcagctttctgcccccaccaacaccctccaaccaggccttgccttctgagagcccccgtggccaagcccaggtcacagatcttcccccgaccatgctgggaatccagaaacagggaccccatttgtcttcccatatctggtggaggtgagggggctcctcaaaagggaactgagaggctgctcttagggagggcaaaggttcgggggcagccagtgtctcccatcagtgccttttttaataaaagctctttcatctatagtttggccaccatacagtggcctcaaagcaaccatggcctacttaaaaaccaaaccaaaaataaagagtttagttgaggagaaa

SEQ ID NO: 115648 - DNA, 547 bp, Homo sapiens
  Payload ID: 2568
  Gene Symbol: CD5
  Gene Name: CD5 molecule
  ENST ID: ENST00000544014
  CDS Start-End: 53-547
ctcacctgcggtgcccagctgcccaggctgaggcaagagaaggccagaaaccatgcccatggggtctctgcaaccgctggccaccttgtacctgctggggatgctggtcgcttcctgcctcggacggctcagctggtatgacccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttagaaccccagaagacaacacctccaacgacaaggcccccgcccaccacaactccagagcccacagctatgaggcccaggacaagacccaggacctgg

SEQ ID NO: 115649 - DNA, 2191 bp, Homo sapiens
  Payload ID: 2569
  Gene Symbol: CD5L
  Gene Name: CD5 molecule-like
  Uniprot ID: O43866
  ENST ID: ENST00000368174
  CDS Start-End: 98-1141
ctcctcttaacatacttgcagctaaaactaaatattgctgcttggggacctccttctagccttaaatttcagctcatcaccttcacctgccttggtcatggctctgctattctccttgatccttgccatttgcaccagacctggattcctagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagaacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcaggatagtatcctggtgttgcttgacctggcccccctggccccgcctgccctctgcttgttctcctgagccctgattatcctcatactcattctggggctcaggcttgagccactactccctcatcccctcaggagtctgaacactgggcttatgccttactctcagggacaagcagcccccattgctgcctgtagatgtgagctgttgagttccctcttgctggggaagatgagcttccatgtatcctgtgctcaaccctgaccctttgacactggttctggcctttcctgccttttctcaagctgcctggaatcctcaaacctgtcactttggtcagatgtgcagaccattactaaggtctatgtctgcaaacattactaatctaggtcctattactaatctatgtctgcaaacattaaaggaatgaaacaatgaaaggaacatttgaaagaaaatgtgggtagacaatttcttgcaacttgggggaaagtttagaattcttttgattggactactttttttttttttcctcaagcttcaggtgaccacaatagcaacacctccctattctgttatttcttagtgtaggtagacaattctttcaggagcagagcagcgtcctataatcctagaccttttcatgacgtgtaaaaaatgatgtttcatcctctgattgccccaataaaaatctttgttgtccatccctatacaacctgccaacatggttgacatttaatgagaggaatgtcaaaaatacattttactttattcaaagaaaaatatattggttactgggaaaaggtcaagaaagaggcagaaagagatcagggagggctaaagttgtgtcttatgccaagcgaaagtgaaaaatatcattttcactttatcaactgagactttggggcctgtaagcttgaggcaagacagaaataagagaatcaagacttgattgtaaaaattgacaactttagattctgaggctaggctgagtacttattatacggctacatttacacatttacacttatctaataaatcagatttcacagtctcaa

SEQ ID NO: 115650 - DNA, 468 bp, Homo sapiens
  Payload ID: 2570
  Gene Symbol: CD52
  Gene Name: CD52 molecule
  Uniprot ID: P31358
  ENST ID: ENST00000374213
  CDS Start-End: 62-247
cagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcaacataagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgca

SEQ ID NO: 115651 - DNA, 1505 bp, Homo sapiens
  Payload ID: 2571
  Gene Symbol: CD53
  Gene Name: CD53 molecule
  Uniprot ID: P19397
  ENST ID: ENST00000271324
  CDS Start-End: 113-772
agccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagtcctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaagtttattatctcaatcacaa

SEQ ID NO: 115652 - DNA, 2220 bp, Homo sapiens
  Payload ID: 2572
  Gene Symbol: CD55
  Gene Name: CD55 molecule, decay accelerating factor for complement (Cromer blood group)
  Uniprot ID: P08174
  ENST ID: ENST00000314754
  CDS Start-End: 66-1388
ccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctggttctcgtcctgtcacccaggctggtatgcggtggtgtgatcgtagctcactgcagtctcgaactcctgggttcaagcgatccttccacttcagcctcccaagtagctggtactacagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggt

SEQ ID NO: 115653 - DNA, 978 bp, Homo sapiens
  Payload ID: 2572
  Gene Symbol: CD55
  Gene Name: CD55 molecule, decay accelerating factor for complement (Cromer blood group)
  ENST ID: ENST00000343420
  CDS Start-End: 1-978
ccgcggcgctgcccctcctcggggagctgccccggctgctgctgctggtgctgttgtgcctgccggccgtgtgggagtccagccgtgtggagcacacgatgctgcaaacttgcatgtcatctctttcaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaacca

SEQ ID NO: 115654 - DNA, 1691 bp, Homo sapiens
  Payload ID: 2572
  Gene Symbol: CD55
  Gene Name: CD55 molecule, decay accelerating factor for complement (Cromer blood group)
  ENST ID: ENST00000367063
  CDS Start-End: 235-1569
gacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctggttctcgtcctgtcacccaggctggtatgcggtggtgtgatcgtagctcactgcagtctcgaactcctgggttcaagcgatccttccacttcagcctcccaagtagctggtactacaggtgtgtgccacgacacccggctaagtttttgaaatttattttttgtagagacaggattttcctatgttgcccaggctggtttcaaactcctggccgtaagcgatttttccggcctcccaaaacgttgcgattataagtgtgagccactgcacctggccccacattttctttatccatttgtacattgatggacacttaagatgattccatatctttgctattgtgaatagtgcttcaataaatatgtgaatgcacata

SEQ ID NO: 115655 - DNA, 2760 bp, Homo sapiens
  Payload ID: 2572
  Gene Symbol: CD55
  Gene Name: CD55 molecule, decay accelerating factor for complement (Cromer blood group)
  Uniprot ID: P08174
  ENST ID: ENST00000367064
  CDS Start-End: 259-1404
gagtctagggcccccggggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctgttttgttgttgaagtactttaaatttcatacgttcatggcatttcactgtaaagactttaatgtgtatttcttaaaataaaactttttttcctccttaa

SEQ ID NO: 115656 - DNA, 1843 bp, Homo sapiens
  Payload ID: 2572
  Gene Symbol: CD55
  Gene Name: CD55 molecule, decay accelerating factor for complement (Cromer blood group)
  ENST ID: ENST00000367067
  CDS Start-End: 34-1686
cggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacacctaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaagg

SEQ ID NO: 115657 - DNA, 2433 bp, Homo sapiens
  Payload ID: 2572
  Gene Symbol: CD55
  Gene Name: CD55 molecule, decay accelerating factor for complement (Cromer blood group)
  ENST ID: ENST00000391921
  CDS Start-End: 124-1077
actcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctgttttgttgttgaagtactttaaatttcatacgttcatggcatttcactgtaaagactttaatgtgtatttcttaaaataaaactttttttcctccttaa

SEQ ID NO: 115658 - DNA, 892 bp, Homo sapiens
  Payload ID: 2573
  Gene Symbol: CD58
  Gene Name: CD58 molecule
  ENST ID: ENST00000369487
  CDS Start-End: 68-790
gtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtatgtatgctttttaaaacaaaatagtttgaaaacttgcattgttttccaaaggtcagaaaatagtttaaggatgaaaataaagtttgaaattttagacatttgaaaagaaacaaaaa

SEQ ID NO: 115659 - DNA, 1098 bp, Homo sapiens
  Payload ID: 2573
  Gene Symbol: CD58
  Gene Name: CD58 molecule
  Uniprot ID: P19256
  ENST ID: ENST00000369489
  CDS Start-End: 68-820
gtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaagtg

SEQ ID NO: 115660 - DNA, 1328 bp, Homo sapiens
  Payload ID: 2573
  Gene Symbol: CD58
  Gene Name: CD58 molecule
  Uniprot ID: P19256
  ENST ID: ENST00000457047
  CDS Start-End: 55-801
gaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaagtaagtacactgcaggctgtgcactctgtgccagaacaacagcagccctgctgtagatgcccattacttgggaagccagattgtactcatctgttggttgccttgtacagtaataagaagtaacatcagcagatatactaaccatagtgtattaagtaccaactgtgtgccatgcactgcactagccactctctgcatatcgtttcctggaaccctctcaatgagccttgcaggaggagtatcataccccttgcttagagacagcgcatatgagattcatagaagtcaagtgagatatcaaagtcacgttgctagtaagtgatgggctgggatttaaatctaggtctttggactccaagagttatactgttaaccactacaatacactccctccacctcccatcccagaaaaagttggatcagggatagggttcacttcaggagccagggtcagagctgggcctgtagtcacatataaaagataggacacaaacacaattagcagcagtgttggtttaataaaccgccgta

SEQ ID NO: 115661 - DNA, 874 bp, Homo sapiens
  Payload ID: 2573
  Gene Symbol: CD58
  Gene Name: CD58 molecule
  Uniprot ID: P19256
  ENST ID: ENST00000464088
  CDS Start-End: 13-726
gcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatgttctttaattgagaagacaatttcttcatttttaggtattctgaaatgtgacagaaaaccagacagaaccaactccaattgattggtaacagaagatgaagacaacagcataactaaattattttaaaaactaaaaagccatctgatttctcattt

SEQ ID NO: 115662 - DNA, 395 bp, Homo sapiens
  Payload ID: 2573
  Gene Symbol: CD58
  Gene Name: CD58 molecule
  ENST ID: ENST00000526981
  CDS Start-End: 1-395
ttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttggtcattcaagacacagatatgcacttatacccataccattagcagtaattacaacatgtattgtgctgtatatgaatggtattctgaaatgtgacagaaaaccagacagaaccaa

SEQ ID NO: 115663 - DNA, 1775 bp, Homo sapiens
  Payload ID: 2574
  Gene Symbol: CD59
  Gene Name: CD59 molecule, complement regulatory protein
  Uniprot ID: P13987
  ENST ID: ENST00000351554
  CDS Start-End: 128-514
aaagaatgcgggggctgagcgcagaagcggctcgaggctggaagaggatcttgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaacc

SEQ ID NO: 115664 - DNA, 1889 bp, Homo sapiens
  Payload ID: 2574
  Gene Symbol: CD59
  Gene Name: CD59 molecule, complement regulatory protein
  Uniprot ID: P13987
  ENST ID: ENST00000395850
  CDS Start-End: 77-463
tgcgggggctgagcgcagaagcggctcgaggctggaagaggatcttgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaat

SEQ ID NO: 115665 - DNA, 741 bp, Homo sapiens
  Payload ID: 2574
  Gene Symbol: CD59
  Gene Name: CD59 molecule, complement regulatory protein
  Uniprot ID: P13987
  ENST ID: ENST00000426650
  CDS Start-End: 55-441
attatacttcttacagtgaggagccagagcttccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtggg

SEQ ID NO: 115666 - DNA, 825 bp, Homo sapiens
  Payload ID: 2574
  Gene Symbol: CD59
  Gene Name: CD59 molecule, complement regulatory protein
  Uniprot ID: P13987
  ENST ID: ENST00000445143
  CDS Start-End: 111-497
atttgactcactgaccctgatggggaagatagtgttattcccacagtgtggtagtacacactggggcttatagggactgagcctactcaagggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcc

SEQ ID NO: 115667 - DNA, 1878 bp, Homo sapiens
  Payload ID: 2574
  Gene Symbol: CD59
  Gene Name: CD59 molecule, complement regulatory protein
  Uniprot ID: P13987
  ENST ID: ENST00000415002
  CDS Start-End: 266-652
tgatggggaagatagtgttattcccacagtgtggtagtacacactggggcttatagggactgagcctactcaagggtatatggtgctgtgggtcagagctggggcatggcccagggattcagtgtgccttgactccccctgtaaatgttcctctcagaagccttcttggccttccagcccttggtttttgagacaaccagcagtcatttgttcgttcctgacattccttcctgtcccttccttccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttga

SEQ ID NO: 115668 - DNA, 758 bp, Homo sapiens
  Payload ID: 2574
  Gene Symbol: CD59
  Gene Name: CD59 molecule, complement regulatory protein
  Uniprot ID: P13987
  ENST ID: ENST00000437761
  CDS Start-End: 175-561
tttgactcactgaccctgatggggaagatagtgttattcccacagtgtggtagtacacactggggcttatagggactgagcctactcaagggtatatggtgctgtgggtcagagctggggcatggcccagggattcagtgtgccttgactccccctgttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccactt

SEQ ID NO: 115669 - DNA, 572 bp, Homo sapiens
  Payload ID: 2574
  Gene Symbol: CD59
  Gene Name: CD59 molecule, complement regulatory protein
  ENST ID: ENST00000534312
  CDS Start-End: 12-404
ggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatgacacattcctgaaggcgctaaaagacgaaaagttacaaggactgaagaccaagcaacctggaaagaagtcggcctctctctcctgaggagctgcctaccagagcttgggcagccacctccttaggtgttagtgcttagataatgtgtcccatttgttgtcatttcaaagatggttattttctgttctgtatttaccgctgttcttgttgctaccagcatgtacttcacatacagtgcccactttgtgtggtaaa

SEQ ID NO: 115670 - DNA, 686 bp, Homo sapiens
  Payload ID: 2574
  Gene Symbol: CD59
  Gene Name: CD59 molecule, complement regulatory protein
  Uniprot ID: P13987
  ENST ID: ENST00000527577
  CDS Start-End: 179-565
gcagaagcggctcgaggctggaagaggatcttgggcgccgccagtctctctctgttgcccaagctggagtgcagtggcacagtcttggctcactgcaacctccacctcctgggtgcaagcgattctcgtgtctcagcctctcaagtagctgggattacaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattag

SEQ ID NO: 115671 - DNA, 652 bp, Homo sapiens
  Payload ID: 2574
  Gene Symbol: CD59
  Gene Name: CD59 molecule, complement regulatory protein
  Uniprot ID: P13987
  ENST ID: ENST00000528700
  CDS Start-End: 221-607
gaagcggctcgaggctggaagaggatcttgggcgccgccagtctctctctgttgcccaagctggagtgcagtggcacagtcttggctcactgcaacctccacctcctgggtgcaagcgattctcgtgtctcagcctctcaagtagctgggattacagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtag

SEQ ID NO: 115672 - DNA, 789 bp, Homo sapiens
  Payload ID: 2574
  Gene Symbol: CD59
  Gene Name: CD59 molecule, complement regulatory protein
  Uniprot ID: P13987
  ENST ID: ENST00000525763
  CDS Start-End: 23-409
ccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaaacacattcctgaaggcgctaaaagacgaaaagttacaaggactgaagaccaagcaacctggaaagaagtcggcctctctctcctgaggagctgcctaccagagcttgggcagccacctccttaggtgttagtgcttagataatgtgtcccatttgttgtc

SEQ ID NO: 115673 - DNA, 424 bp, Homo sapiens
  Payload ID: 2574
  Gene Symbol: CD59
  Gene Name: CD59 molecule, complement regulatory protein
  ENST ID: ENST00000533181
  CDS Start-End: 1-158
cccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagttcagagcctggggcctgagaattaaactgacaaagacagattaa

SEQ ID NO: 115674 - DNA, 1847 bp, Homo sapiens
  Payload ID: 2574
  Gene Symbol: CD59
  Gene Name: CD59 molecule, complement regulatory protein
  ENST ID: ENST00000533403
  CDS Start-End: 46-405
ctggaagaggatcttgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgagttgggatatcactatgttgcccaggctggccgcaggcaatcctctcacttcagcctcctaaagtgctgggattacaggtgtgagccatcacactggcctcattgtccatattttaattggggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatga

SEQ ID NO: 115675 - DNA, 633 bp, Homo sapiens
  Payload ID: 2574
  Gene Symbol: CD59
  Gene Name: CD59 molecule, complement regulatory protein
  ENST ID: ENST00000527926
  CDS Start-End: 4-330
acaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggttcagagcctggggcctgagaattaaactgacaaagacagattaacagaagacaaagtttattacgcagacacattcctgaaggcgctaaaagacgaaaagttacaaggactgaagaccaagcaacctggaaagaagtcggcctctctctcctgaggagctgcctaccagagcttgggcagccacctccttaggtgttagtgcttagataatgtgtcccatttgttgtcatttcaaagatggttattttctgttctgtatttaccgctgttcttgttgctaccagcatgtacttcacatacagtgcccactttgtgtggtaa

SEQ ID NO: 115676 - DNA, 3252 bp, Homo sapiens
  Payload ID: 2575
  Gene Symbol: CD6
  Gene Name: CD6 molecule
  Uniprot ID: P30203
  ENST ID: ENST00000313421
  CDS Start-End: 187-2193
actcacaggttgggtttgatcgcatgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatgaaa

SEQ ID NO: 115677 - DNA, 3022 bp, Homo sapiens
  Payload ID: 2575
  Gene Symbol: CD6
  Gene Name: CD6 molecule
  ENST ID: ENST00000344931
  CDS Start-End: 121-1527
gaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgc

SEQ ID NO: 115678 - DNA, 1809 bp, Homo sapiens
  Payload ID: 2575
  Gene Symbol: CD6
  Gene Name: CD6 molecule
  Uniprot ID: P30203
  ENST ID: ENST00000352009
  CDS Start-End: 1-1806
atgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagggtcccccagccctcagcctgactccaccgacaacgatgactacgatgacatcagcgcagcctaggcc

SEQ ID NO: 115679 - DNA, 1782 bp, Homo sapiens
  Payload ID: 2575
  Gene Symbol: CD6
  Gene Name: CD6 molecule
  Uniprot ID: P30203
  ENST ID: ENST00000452451
  CDS Start-End: 1-1779
atgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagggtcccccagccctcagcctgactccaccgacaacgatgactacgatgacatcagcgcagcctaggcc

SEQ ID NO: 115680 - DNA, 1268 bp, Homo sapiens
  Payload ID: 2575
  Gene Symbol: CD6
  Gene Name: CD6 molecule
  ENST ID: ENST00000433107
  CDS Start-End: 1-1268
atgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagta

SEQ ID NO: 115681 - DNA, 835 bp, Homo sapiens
  Payload ID: 2575
  Gene Symbol: CD6
  Gene Name: CD6 molecule
  ENST ID: ENST00000542157
  CDS Start-End: 1-835
atgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagaatcttctgtgacagtgaaaatagagaacaaggaatctcgggagctaatgctcc

SEQ ID NO: 115682 - DNA, 556 bp, Homo sapiens
  Payload ID: 2575
  Gene Symbol: CD6
  Gene Name: CD6 molecule
  ENST ID: ENST00000538611
  CDS Start-End: 1-556
agaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccac

SEQ ID NO: 115683 - DNA, 547 bp, Homo sapiens
  Payload ID: 2575
  Gene Symbol: CD6
  Gene Name: CD6 molecule
  ENST ID: ENST00000542254
  CDS Start-End: 131-247
acaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggatgcacagttgccaaatggattcagctccttggagaaatatgttgctttgccgggatgggattctagaagtatgacaatgtctgagctggaagaaaccccagcgagctgccagccatctcctgtttgtcagaggaggaaagcgaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcgggg

SEQ ID NO: 115684 - DNA, 1070 bp, Homo sapiens
  Payload ID: 2576
  Gene Symbol: CD63
  Gene Name: CD63 molecule
  Uniprot ID: P08962
  ENST ID: ENST00000257857
  CDS Start-End: 280-996
cgggggtgggcgccttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggatta

SEQ ID NO: 115685 - DNA, 981 bp, Homo sapiens
  Payload ID: 2576
  Gene Symbol: CD63
  Gene Name: CD63 molecule
  Uniprot ID: P08962
  ENST ID: ENST00000420846
  CDS Start-End: 147-863
cgcccggagactggcgggccgagggtcggcgtcaggctcaagcccctgccggcgcccttggatctgtcctgggccccagaggcggcggggcggggtccgggcttcgcggccgtcgcccccacccctctcctgcgggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtg

SEQ ID NO: 115686 - DNA, 788 bp, Homo sapiens
  Payload ID: 2576
  Gene Symbol: CD63
  Gene Name: CD63 molecule
  ENST ID: ENST00000551173
  CDS Start-End: 144-788
ccggagactggcgggccgagggtcggcgtcaggctcaagcccctgccggcgcccttggatctgtcctgggccccagaggcggcggggcggggtccgggcttcgcggccgtcgcccccacccctctcctgcgggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgctttt

SEQ ID NO: 115687 - DNA, 682 bp, Homo sapiens
  Payload ID: 2576
  Gene Symbol: CD63
  Gene Name: CD63 molecule
  Uniprot ID: P08962
  ENST ID: ENST00000552754
  CDS Start-End: 9-656
cggcagccatggcggtggaaggaggaatgaaatgtgtgaagttcttgctctacgtcctcctgctggccttttgcggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcat

SEQ ID NO: 115688 - DNA, 779 bp, Homo sapiens
  Payload ID: 2576
  Gene Symbol: CD63
  Gene Name: CD63 molecule
  Uniprot ID: P08962
  ENST ID: ENST00000546939
  CDS Start-End: 218-688
gcccctctccccctttccctcctcccagcgcttgggggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 115689 - DNA, 1233 bp, Homo sapiens
  Payload ID: 2576
  Gene Symbol: CD63
  Gene Name: CD63 molecule
  Uniprot ID: P08962
  ENST ID: ENST00000549117
  CDS Start-End: 438-1154
gtggcttcggggaagggcttcctccccttttctcagactaggatccctggaaaatggagaagctgtgctaatagaggggggccagaaatccccactctagaatgctgtagaatgttgggagacacccaggatgtgagccagggactttctggaagtgtttgttctggccccacccgaccccaggcagtccccagctgtctgcacagtcggatggggagggggcttgcacagagttggagccagaggagagagctggctcatcccctacggtaggatggggaaacctcacagaccacattgtcacccggcctcagctctccgccccggcgctcagagggtaactctcacccacctcgtccgcttctctgaaccagagtgacccaggctgcgctccgccccgctctcctaccccgagttggcacggaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttt

SEQ ID NO: 115690 - DNA, 727 bp, Homo sapiens
  Payload ID: 2576
  Gene Symbol: CD63
  Gene Name: CD63 molecule
  ENST ID: ENST00000548898
  CDS Start-End: 52-489
agagcagcttggttcgggctcaggaagtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtgatgcttgattccttcctttccttactgatgttccctgtcctctgggaccttaatgcatgtgtacttcgaggtctattttggggggtgtttgggaaaggaggactttgcgaaggtgttggt

SEQ ID NO: 115691 - DNA, 870 bp, Homo sapiens
  Payload ID: 2576
  Gene Symbol: CD63
  Gene Name: CD63 molecule
  Uniprot ID: P08962
  ENST ID: ENST00000550776
  CDS Start-End: 385-855
ggcttgagaggctactgtttgtctagggagggacacatcactcttgctcccttttcctcttcccttctcctggcctaactggccagaggaaccttagtcacagctgatgcgcgcgtgggatgtgcactggaggatagtgagggggcagttctgggagagaattgagctgggagccctggaggcctgtagaaagcattattctaggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctc

SEQ ID NO: 115692 - DNA, 845 bp, Homo sapiens
  Payload ID: 2576
  Gene Symbol: CD63
  Gene Name: CD63 molecule
  ENST ID: ENST00000552164
  CDS Start-End: 194-845
gcgcagccagccttgggaagcccaggtgaggccgcggggacccggcggacttcggcgcgggctgggagagaccacccgcagtcccttcctccagggctcgccccaggcccgcggagactcgtccggcgctctccagccgccctggagcaactttgcttcgaagttccctgggcccgggcagggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgagg

SEQ ID NO: 115693 - DNA, 949 bp, Homo sapiens
  Payload ID: 2576
  Gene Symbol: CD63
  Gene Name: CD63 molecule
  Uniprot ID: P08962
  ENST ID: ENST00000552692
  CDS Start-End: 142-858
gcgggtttccgggtgggaggggccgggaatcggggccgtgaagggaagccctcgagggccggccgggagcccggaaaccgaggtcccccttcggccagttttaatccccccgccctcccctctgccccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 115694 - DNA, 829 bp, Homo sapiens
  Payload ID: 2576
  Gene Symbol: CD63
  Gene Name: CD63 molecule
  ENST ID: ENST00000550050
  CDS Start-End: 60-392
cggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccagg

SEQ ID NO: 115695 - DNA, 648 bp, Homo sapiens
  Payload ID: 2576
  Gene Symbol: CD63
  Gene Name: CD63 molecule
  ENST ID: ENST00000548160
  CDS Start-End: 120-557
gaagacctttgtgagtgtccagggaccggctgtgccaaaacgggcccctgtaatgcatagactccaaacttgacttctgtcctttgctcctgcagtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 115696 - DNA, 621 bp, Homo sapiens
  Payload ID: 2576
  Gene Symbol: CD63
  Gene Name: CD63 molecule
  ENST ID: ENST00000552067
  CDS Start-End: 71-508
atgggcggtctgggactgccagagcagcttggttcgggctcaggaagttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtctta

SEQ ID NO: 115697 - DNA, 607 bp, Homo sapiens
  Payload ID: 2576
  Gene Symbol: CD63
  Gene Name: CD63 molecule
  ENST ID: ENST00000546457
  CDS Start-End: 209-607
tggaaaatggagaagctgtgctaatagaggggggccagaaatccccactctagaatgctgtagaatgttgggagacacccaggatctctccgccccggcgctcagagggtaactctcacccacctcgtccgcttctctgaaccagagtgacccaggctgcgctccgccccgctctcctaccccgagttggcacggaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgct

SEQ ID NO: 115698 - DNA, 1878 bp, Homo sapiens
  Payload ID: 2577
  Gene Symbol: CD68
  Gene Name: CD68 molecule
  Uniprot ID: P34810
  ENST ID: ENST00000250092
  CDS Start-End: 212-1276
agggccaacagtcccctaacttaattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcaca

SEQ ID NO: 115699 - DNA, 1771 bp, Homo sapiens
  Payload ID: 2577
  Gene Symbol: CD68
  Gene Name: CD68 molecule
  Uniprot ID: P34810
  ENST ID: ENST00000380498
  CDS Start-End: 188-1171
ttacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtca

SEQ ID NO: 115700 - DNA, 891 bp, Homo sapiens
  Payload ID: 2577
  Gene Symbol: CD68
  Gene Name: CD68 molecule
  ENST ID: ENST00000584180
  CDS Start-End: 1-364
caaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtaagacctacctactccttccctcctagaatcctcccactgcactgaaaaccccttccccaggcccataagccactcatctctcttcttaaccccccaaatctcgctctcccagcttgtcatggctacagggcagctttctttccatcctctacaagactctgccagtttcccccttttatcactgctgagtcactgcggtgagctcctcaccaatctcctactccccagcatccccccattccctcctcccacctttatcccaaccagcacgtcactgcaaatacctacctgccctatccttccgccaggtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttc

SEQ ID NO: 115701 - DNA, 582 bp, Homo sapiens
  Payload ID: 2577
  Gene Symbol: CD68
  Gene Name: CD68 molecule
  ENST ID: ENST00000584502
  CDS Start-End: 41-582
gcagacagcctagctggactttgggtgaggcggttcagccatgaggctggctgtgcttttctcgggggccctgctggggctactggcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctc

SEQ ID NO: 115702 - DNA, 1676 bp, Homo sapiens
  Payload ID: 2578
  Gene Symbol: CD69
  Gene Name: CD69 molecule
  Uniprot ID: Q07108
  ENST ID: ENST00000228434
  CDS Start-End: 82-681
agactcaacaagagctccagcaaagactttcactgtagcttgacttgacctgagattaactagggaatcttgagaataaagatgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatgaactttctaaaacgatacgcaggtagagaggaacactgggttggactgaaaaaggaacctggtcacccatggaagtggtcaaatggcaaagaatttaacaactggttcaacgttacagggtctgacaagtgtgtttttctgaaaaacacagaggtcagcagcatggaatgtgagaagaatttatactggatatgtaacaaaccttacaaataataaggaaacatgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactattggaaggagttagatgttggtactagatactgaatgtaaacaaaggaattatggctggtaacataggtttttagtctaattgaatcccttaaactcagggagcatttataaatggacaaatgcttatgaaactaagatttgtaatatttctctctttttagagaaatttgccaatttactttgttatttttccccaaaaagaatgggatgatcatgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaa

SEQ ID NO: 115703 - DNA, 1020 bp, Homo sapiens
  Payload ID: 2578
  Gene Symbol: CD69
  Gene Name: CD69 molecule
  ENST ID: ENST00000536709
  CDS Start-End: 82-576
agactcaacaagagctccagcaaagactttcactgtagcttgacttgacctgagattaactagggaatcttgagaataaagatgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatgaactttctaaaacgatacgcaggtagagaggaacactgggttggactgaaaaaggaacctggtcacccatggaagtggtcaaatggcaaagaatttaacaactggtaagtctccagaagtctctttatattccccagggtggcatctcaggaaaatcactttccttttctcctttcaaagcactttaaatataaaggctgagctcttcaagagctctaacaatctcttctgaatgcgtatactctggaattctttaataacaggctttattattattctttttctttatccacacttataatacataaaataaatgcttatagtaatttttctcagcaaactctaatgtgagtagtagatctggttaatttggaaatatttcaataataattatgatgatgcaacaaaaacccattttcaatgtcacatttagtctttactaataagacagttgctggaaaataaatccttcttactatttctcagttttcatctccacagaataaagaatagtttcaatgcctaattatgagtttctatacacctgaaaga

SEQ ID NO: 115704 - DNA, 1281 bp, Homo sapiens
  Payload ID: 2579
  Gene Symbol: CD7
  Gene Name: CD7 molecule
  Uniprot ID: P09564
  ENST ID: ENST00000312648
  CDS Start-End: 108-830
gagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttccttt

SEQ ID NO: 115705 - DNA, 1659 bp, Homo sapiens
  Payload ID: 2579
  Gene Symbol: CD7
  Gene Name: CD7 molecule
  ENST ID: ENST00000583376
  CDS Start-End: 790-1212
tagacccagagaggctcagctgcactcgcccggctgggagagctgggtgtggggaacatggccgggcctccgaggctcctgctgctgcccctgcttctggcgctggctcgcggcctgcctggggccctggctgcccaaggtaagagcttcccaggctctccatggccacagctccagagctctccctgccccatgagctcagagcccccagtctgagccacagcacagcccccaggaagcgggtggggtgctgagcggcctccagtgtctgaggactcatttaagagaaggaaaaagggtggaccccggtggggagtggccggggctgtccaggcagggccgctgctttgggaggaagaagcccacagtctcggaacacgaggacagcacctcccccaacaccacagccggtgcccagatctgctccatgccccgtaaggcaccgtgtctttggcgacatgtcagccctgggctgtctcagggccccaccatccccaccactgtcccctgcagggaggacattctctgtccttctggccagactgatggtgacagcccaggtcctccccagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttc

SEQ ID NO: 115706 - DNA, 2021 bp, Homo sapiens
  Payload ID: 2579
  Gene Symbol: CD7
  Gene Name: CD7 molecule
  ENST ID: ENST00000584284
  CDS Start-End: 83-748
gtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacaggtcagtgtgagccccagctgccacctgcaccccaaagattgttccctctcctgagagcagcgtggggggcgccaaagccccagaggaaaaccctggtacccgccgcctcctctgcaggctctggaactctcagggtggaagtggcctcggcggggagggagggggaccagcaccaaagcgacctgagggggagggagcagcccaggcgctgggcccgcgtgtgcgcgtgtgcgcgtgtgcaggtgtgagtgtctgaggggggatctctgaggtctgtgcgtgcaggttggagtgtgcgggcagaggagggagcgcccaggcgctgggcccgcgtgtgcacgtgtgcaggtgtgagcctgtgtgtggggatctctgaggactgtgcgtgcatgttggagtgtgccggcgtgctgtgtggccgtgggaaggggagggggcctcagacagacacagagtctaggcgtggccactcccctcggtccctgctgtttgtctggggctggagtgggggtcccgcttggcttgggcttggtgggggggtccaagccacttccactctccttcttcagaggcaccccagggtccgacccagccctgcctggggaaggctctgctgggaagccctggggctcaggagacctgggggccagcccagaggagccccgtgggggtctcgtgttaaaattagaaagctgaccggagtggggtggggtccaggacaccacgctggccactggttggagacggcggttctgtctttcagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttccttttc

SEQ ID NO: 115707 - DNA, 564 bp, Homo sapiens
  Payload ID: 2579
  Gene Symbol: CD7
  Gene Name: CD7 molecule
  ENST ID: ENST00000582480
  CDS Start-End: 85-564
ctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagggaggacattctctgtccttctggccagactgatggtgacagcccaggtcctccccagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacag

SEQ ID NO: 115708 - DNA, 572 bp, Homo sapiens
  Payload ID: 2579
  Gene Symbol: CD7
  Gene Name: CD7 molecule
  ENST ID: ENST00000581434
  CDS Start-End: 56-163
gacccagagaggctcagctgcactcgcccggctgggagagctgggtgtggggaacatggccgggcctccgaggctcctgctgctgcccctgcttctggcgctggctcgcggcctgcctggggccctggctgcccaagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggt

SEQ ID NO: 115709 - DNA, 925 bp, Homo sapiens
  Payload ID: 2579
  Gene Symbol: CD7
  Gene Name: CD7 molecule
  ENST ID: ENST00000578509
  CDS Start-End: 394-759
gtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagactgatggtgacagcccaggtcctccccagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacaggtcagtgtgagccccagctgccacctgcaccccaaagattgttccctctcctgagagcagcgtggggggcgccaaagccccagaggaaaaccctggtacccgccgcctcctctgcaggctctggaactctcagggtggaagtggcctcggcggggagggagggggaccagcaccaaagcgacctgagggggagggagcagcccaggcgctgggcccgcgt

SEQ ID NO: 115710 - DNA, 913 bp, Homo sapiens
  Payload ID: 2580
  Gene Symbol: CD70
  Gene Name: CD70 molecule
  Uniprot ID: P32970
  ENST ID: ENST00000245903
  CDS Start-End: 151-732
ccagagaggggcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggggtagtggtggcaggacaagagaaggcattgagctttttctttcattttcctattaaaaaatacaaaaatca

SEQ ID NO: 115711 - DNA, 881 bp, Homo sapiens
  Payload ID: 2580
  Gene Symbol: CD70
  Gene Name: CD70 molecule
  Uniprot ID: P32970
  ENST ID: ENST00000423145
  CDS Start-End: 138-764
ggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaagggctttttggattttggaactggggactcaaagtcaagtgcttcttacggcatttaatatggactgcacactgttttatcccattaactcagctcgtgttcatgcaagccctacaaagctggaggaatcatcattgttcccatttcacagatgaggaaaacagaggcgtaaaccgttgagtcatctgtccaaagttactggttttgtaacagctggaacctcagtatttaacagttgaggaaaatagtggcagaaaacctgagtcacaagcccgaggcaattcatctacatagtag

SEQ ID NO: 115712 - DNA, 572 bp, Homo sapiens
  Payload ID: 2580
  Gene Symbol: CD70
  Gene Name: CD70 molecule
  ENST ID: ENST00000597430
  CDS Start-End: 377-572
tttttgaccttcctgtttcctggaactcagccatggtggtgtgtcactttgtactttgcagacaagggcatcacctttgatgtgtcggaggcacttcagtgaaagaattttggctcctaaagattttgcagaacagagatgacatgccagcccagactttcatttccaggaggccatgaattctgggaggacaccgttaacccactacagccatcgagaacagcagcaggaggctggatgcggtggctcacacctgtcatcccggcactttgggggacctacgcagcaggatcgcttgagcccagatgtttgagaccagcctgcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacag

SEQ ID NO: 115713 - DNA, 1548 bp, Homo sapiens
  Payload ID: 2581
  Gene Symbol: CD72
  Gene Name: CD72 molecule
  Uniprot ID: P21854
  ENST ID: ENST00000259633
  CDS Start-End: 125-1204
aattgctaagccgtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattg

SEQ ID NO: 115714 - DNA, 585 bp, Homo sapiens
  Payload ID: 2581
  Gene Symbol: CD72
  Gene Name: CD72 molecule
  ENST ID: ENST00000378430
  CDS Start-End: 87-449
ctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgtgagtgtgcctgtgcggggcagccgcggggccaagtgctcgcgcctgtcccggctgcggatggcgctgggccccgcggggtgcagctccttccgggataaacccgggcgcagtccttccgacgcccgggctgccgtgccacattcaccttcatccggtgcgcctgaatccgacgtgcaccgcccccctgcggatggtcccaattcacctacctgccccccttcccctctctccgtc

SEQ ID NO: 115715 - DNA, 849 bp, Homo sapiens
  Payload ID: 2581
  Gene Symbol: CD72
  Gene Name: CD72 molecule
  ENST ID: ENST00000378431
  CDS Start-End: 68-427
gacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctgtgagtaaggctgtccctacttcccacttacaccgaacgactttcgtcccgactctcgccccaaagctgatcttcctcagcagggatcatagtcactaccaccacctccttagctttgggtttggtttccagccagggctgttgtcttcctgaattgtcctcacctaatccagtacctccttacgctttagtcagtcaaatcttgtatttcagcctgtgatgcaaaaagttgcaagaagcagaaaaagggctgatgctgcagtctcagggcactagggcagggctggagaagacatccaccaaatctctgtggccaaacagatctgcaggtgtctcagcagctccagcagacgaacagggttctggaagtcactaacagcagcctgaggcagcagctccgcctcaagataacgcagctgggacagagtgc

SEQ ID NO: 115716 - DNA, 2035 bp, Homo sapiens
  Payload ID: 2581
  Gene Symbol: CD72
  Gene Name: CD72 molecule
  Uniprot ID: P21854
  ENST ID: ENST00000396757
  CDS Start-End: 166-1245
caccaccaatcatccgagctgttggcatgtgtcacagggccaattgctaagccgtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaatgctgtgtctggttcagtgatccccacgggaacgcgagccggggggtcgactggaagtgctctgtcccttgagtccatgctggggctcccctacacggggagaagagccggtcagcccatctggaactggcactgtccagcaagtgtgctctgttcttacagggtgtcctgaaggccaaagttggaggcctgagaccacgggctccactgctaagagcgtgccccaggcagctgcaggctgggtgtgggtggcttggcgtggtgccctcggtggcagaggagactgcccgcctcacagttcaggttgcggtagcgggcaacagctggtgtggggcgggggcacatggacaggaagccaaagctgaaggggccgaggcagcagccaggacagggcagcccctcatcgggctcccggggagc

SEQ ID NO: 115717 - DNA, 1424 bp, Homo sapiens
  Payload ID: 2581
  Gene Symbol: CD72
  Gene Name: CD72 molecule
  ENST ID: ENST00000612238
  CDS Start-End: 1-1080
atgcaaaccaggaacccccagtctcatggggagaacggagcctcaccctggagctggggagatcgtctgggccctggcccagacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattg

SEQ ID NO: 115718 - DNA, 981 bp, Homo sapiens
  Payload ID: 2582
  Gene Symbol: CD74
  Gene Name: CD74 molecule, major histocompatibility complex, class II invariant chain
  Uniprot ID: P04233
  ENST ID: ENST00000009530
  CDS Start-End: 3-893
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatct

SEQ ID NO: 115719 - DNA, 1449 bp, Homo sapiens
  Payload ID: 2582
  Gene Symbol: CD74
  Gene Name: CD74 molecule, major histocompatibility complex, class II invariant chain
  Uniprot ID: P04233
  ENST ID: ENST00000353334
  CDS Start-End: 181-879
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatgg

SEQ ID NO: 115720 - DNA, 1138 bp, Homo sapiens
  Payload ID: 2582
  Gene Symbol: CD74
  Gene Name: CD74 molecule, major histocompatibility complex, class II invariant chain
  Uniprot ID: P04233
  ENST ID: ENST00000377795
  CDS Start-End: 21-503
ccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 115721 - DNA, 584 bp, Homo sapiens
  Payload ID: 2582
  Gene Symbol: CD74
  Gene Name: CD74 molecule, major histocompatibility complex, class II invariant chain
  ENST ID: ENST00000524315
  CDS Start-End: 3-461
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccaggaagtggccaaaagctagacagatccccgttcctgacatcacagcagcctccaacacaaggctccaagacctaggctcatggacgagatgggaaggcacagggagaagggataaccctacacccagaccccaggctggaca

SEQ ID NO: 115722 - DNA, 546 bp, Homo sapiens
  Payload ID: 2582
  Gene Symbol: CD74
  Gene Name: CD74 molecule, major histocompatibility complex, class II invariant chain
  ENST ID: ENST00000523813
  CDS Start-End: 3-161
agatgcacaggaggagaagcaggagctgtcgggaagatcagaagccagtcatggatgaccagcgcgaccttatctccaacaatgagcaactgcccatgctgggccggcgccctggggccccggagagcccatgcagaatgccaccaagtatggcaacatgacagaggaccatgtgatgcacctgctccagcactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctga

SEQ ID NO: 115723 - DNA, 563 bp, Homo sapiens
  Payload ID: 2582
  Gene Symbol: CD74
  Gene Name: CD74 molecule, major histocompatibility complex, class II invariant chain
  ENST ID: ENST00000522246
  CDS Start-End: 3-371
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagccccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaaggtacagggagtgggag

SEQ ID NO: 115724 - DNA, 1727 bp, Homo sapiens
  Payload ID: 2582
  Gene Symbol: CD74
  Gene Name: CD74 molecule, major histocompatibility complex, class II invariant chain
  ENST ID: ENST00000518797
  CDS Start-End: 1-949
caggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtgacgctgggccactctccaacattcctgggatgtccatttcacagacgaaggaacagggttggggggctgtggggagttacacaaatccatgatggtcattattggacctgagcagggggcaggggagggtggacagtccttaactgctctgcaggtccaggatgttagaaaggggcagggacaacaaatgggtgaccccaacctcaacctgctgcttctctctccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagcc

SEQ ID NO: 115725 - DNA, 767 bp, Homo sapiens
  Payload ID: 2582
  Gene Symbol: CD74
  Gene Name: CD74 molecule, major histocompatibility complex, class II invariant chain
  ENST ID: ENST00000523208
  CDS Start-End: 1-437
ggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagccc

SEQ ID NO: 115726 - DNA, 1258 bp, Homo sapiens
  Payload ID: 2583
  Gene Symbol: CD79A
  Gene Name: CD79a molecule, immunoglobulin-associated alpha
  Uniprot ID: P11912
  ENST ID: ENST00000221972
  CDS Start-End: 186-866
tccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 115727 - DNA, 567 bp, Homo sapiens
  Payload ID: 2583
  Gene Symbol: CD79A
  Gene Name: CD79a molecule, immunoglobulin-associated alpha
  Uniprot ID: P11912
  ENST ID: ENST00000444740
  CDS Start-End: 1-567
atgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatgagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtga

SEQ ID NO: 115728 - DNA, 801 bp, Homo sapiens
  Payload ID: 2583
  Gene Symbol: CD79A
  Gene Name: CD79a molecule, immunoglobulin-associated alpha
  ENST ID: ENST00000597454
  CDS Start-End: 26-801
aaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccgtgagtggcccagccctggcccctactcccactgtcccgctggggacactcggtttatctttgaagtggggatagagccagtaccttcaatgtgggtttcaaaccggcttggacagagggacggacattctcctctgcagagtggggtctctggggggtctggggccttgcaggaggtgggcggggccaggaggctagggagggcaagaggggccagggctctgagccatactacctccttgcagagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggat

SEQ ID NO: 115729 - DNA, 1269 bp, Homo sapiens
  Payload ID: 2584
  Gene Symbol: CD79B
  Gene Name: CD79b molecule, immunoglobulin-associated beta
  Uniprot ID: P40259
  ENST ID: ENST00000006750
  CDS Start-End: 94-783
aggggacaggctgcagccggtgcagttacacgttttcctccaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgtcagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcctggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagccgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaacca

SEQ ID NO: 115730 - DNA, 378 bp, Homo sapiens
  Payload ID: 2584
  Gene Symbol: CD79B
  Gene Name: CD79b molecule, immunoglobulin-associated beta
  Uniprot ID: P40259
  ENST ID: ENST00000349817
  CDS Start-End: 1-378
atggccaggctggcgttgtctcctgtgcccagccactggatggtggcgttgctgctgctgctctcagctgagccagtaccagcagccagatcggaggaccggtaccggaatcccaaaggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtga

SEQ ID NO: 115731 - DNA, 1254 bp, Homo sapiens
  Payload ID: 2584
  Gene Symbol: CD79B
  Gene Name: CD79b molecule, immunoglobulin-associated beta
  Uniprot ID: P40259
  ENST ID: ENST00000392795
  CDS Start-End: 76-768
ggtgcagttacacgttttcctccaaggagcctcggacgttgtcacgggtttggggtcggggacagagcggtgaccatggccaggctggcgttgtctcctgtgcccagccactggatggtggcgttgctgctgctgctctcagcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgtcagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcctggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagccgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaacca

SEQ ID NO: 115732 - DNA, 2725 bp, Homo sapiens
  Payload ID: 2585
  Gene Symbol: CD80
  Gene Name: CD80 molecule
  Uniprot ID: P33681
  ENST ID: ENST00000264246
  CDS Start-End: 364-1230
aagtaacagaagttagaaggggaaatgtcgcctctctgaagattacccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtcccacctccatttgcaattgacctcttctgggaacttcctcagatggacaagattaccccaccttgccctttacgtatctgctcttaggtgcttcttcacttcagttgctttgcaggaagtgtctagaggaatatggtgggcacagaagtagctctggtgaccttgatcaaggtgttttgaaatgcagaattcttgagttctggaagggactttagagaataccagtgttattaatgacaaaggcactgaggcccagggaggtgacccgaattataaaggccagcgccagaacccagatttcctaactctggtgctctttccctttatcagtttgactgtggcctgttaactggtatatacatatatatgtcaggcaaagtgctgctggaagtagaatttgtccaataacaggtcaacttcagagactatctgatttcctaatgtcagagtagaagattttatgctgctgtttacaaaagcccaatgtaatgcataggaagtatggcatgaacatctttaggagactaatggaaatattattggtgtttacccagtattccatttttttcattgtgttctctattgctgctctctcactcccccatgaggtacagcagaaaggagaactatccaaaactaatttcctctgacatgtaagacgaatgatttaggtacgtcaaagcagtagtcaaggaggaaagggatagtccaaagacttaactggttcatattggactgataatctctttaaatggctttatgctagtttgacctcatttgtaaaatatttatgagaaagttctcatttaaaatgagatcgttgtttacagtgtatgtactaagcagtaagctatcttcaaatgtctaaggtagtaactttccatagggcctccttagatccctaagatggctttttctccttggtatttctgggtctttctgacatcagcagagaactggaaagacatagccaactgctgttcatgttactcatgactcctttctctaaaactgccttccacaattcactagaccagaagtggacgcaacttaagctgggataatcacattatcatctgaaaatctggagttgaacagcaaaagaagacaacatttctcaaatgcacatctcatggcagctaagccacatggctgggatttaaagcctttagagccagcccatggctttagctacctcactatgctgcttcacaaaccttgctcctgtgtaaaactatattctcagtgtagggcagagaggtctaacaccaacataaggtactagcagtgtttcccgtattgacaggaatacttaactcaataattcttttcttttccatttagtaacagttgtgatgactatgtttctattctaagtaattcctgtattctacagcagatactttgtcagcaatactaagggaagaaacaaagttgaaccgtttctttaataa

SEQ ID NO: 115733 - DNA, 771 bp, Homo sapiens
  Payload ID: 2585
  Gene Symbol: CD80
  Gene Name: CD80 molecule
  Uniprot ID: P33681
  ENST ID: ENST00000383669
  CDS Start-End: 1-771
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaagctttgccccaagatgcagagagagaaggaggaatgagagattgagaagggaaagtgtacgccctgtataa

SEQ ID NO: 115734 - DNA, 1491 bp, Homo sapiens
  Payload ID: 2585
  Gene Symbol: CD80
  Gene Name: CD80 molecule
  Uniprot ID: P33681
  ENST ID: ENST00000478182
  CDS Start-End: 318-1184
ccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtagcctccgtcatctcttctgggatacatggatcgtggggatcatgaggcattcttcccttaacaaatttaagctgttttacccactacctcaccttcttaaaaacctctttcagattaagctgaacagttacaagatggctggcatccctctcctttctccccatatgcaatttgcttaatgtaacctcttcttttgccatgtttccattctgccatcttgaattgtcttgtcagccaattcattatctattaaacactaatttgag

SEQ ID NO: 115735 - DNA, 1520 bp, Homo sapiens
  Payload ID: 2586
  Gene Symbol: CD81
  Gene Name: CD81 molecule
  Uniprot ID: P60033
  ENST ID: ENST00000263645
  CDS Start-End: 257-967
agcgaggcgcgcgcccggccagagagcgagcgcgcaacggcggcgacggcggcgaccccaccgcgcatcctgccaggcctccggcgcccagcgccccacgcgcccccgcgcccccgcgcccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaccaggcctgtgcagtccctcag

SEQ ID NO: 115736 - DNA, 880 bp, Homo sapiens
  Payload ID: 2586
  Gene Symbol: CD81
  Gene Name: CD81 molecule
  ENST ID: ENST00000381036
  CDS Start-End: 6-830
gcagcatgtggtgtggttggtctttttcgtggcagccagtccactgggtgcgctcggcatgtggctgcagcttgacctgggtttcctggtccctggcaagctccagctcaaggtccctgctgaaggtcggagagcttggcatggccccgtttgtccatgctagggctgggaagaccaaggctcagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacc

SEQ ID NO: 115737 - DNA, 1172 bp, Homo sapiens
  Payload ID: 2586
  Gene Symbol: CD81
  Gene Name: CD81 molecule
  ENST ID: ENST00000526072
  CDS Start-End: 237-734
aaagaagtattctgttttcatctgagaggcagatttaaccggcgtcccgtgtcttcctggcagtcctgccctggagtcacactccacagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgcct

SEQ ID NO: 115738 - DNA, 890 bp, Homo sapiens
  Payload ID: 2586
  Gene Symbol: CD81
  Gene Name: CD81 molecule
  ENST ID: ENST00000481687
  CDS Start-End: 49-777
atgaggtgcccagtccccatgtggcctccttagtctccgtcctgtgtcatggaagaggtaactgaggcacagaaaactcaccaggccaggctgggatgtgaggtcccttgctgctcatccctggcagtcagcaaccctacatcttcccagctgggcggcccgtggtgggttcggcacccaggaccctccggggtcttgggctgtggcgagtgtgtaggcacccacctggtgtctctctccccgcaaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctac

SEQ ID NO: 115739 - DNA, 1136 bp, Homo sapiens
  Payload ID: 2586
  Gene Symbol: CD81
  Gene Name: CD81 molecule
  ENST ID: ENST00000492252
  CDS Start-End: 510-1136
tggcagccagtccactgggtgcgctcggcatgtggctgcagcttgacctgggtttcctggtccctggcaaggtggagcatctcttcatgtgcttttttgctgtgtgtggatcttgcggggaagggtctgttcctgttttttgcccatctttcaaagattgggttgccagttttcttgctgttgagtttggaaagctctgcatacgttcagggcacaggtcctttaccaggctctgccccaggtctttcggagagcaggtgtctttcgcattcctgactctggggaacctctagccctgccacatggggtttgttatggggcaggggcacctgtgcctttcccaccacggggcttggggatttggtgctgccattgccctccctcgtaggtggccctaggggggtccctccgcctccgtttcctcatccagaaaccggcagtgaccatcaccaccattgttgtcacctagctccagctcaaggtccctgctgaaggtcggagagcttggcatggccccgtttgtccatgctagggctgggaagaccaaggctcagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatg

SEQ ID NO: 115740 - DNA, 396 bp, Homo sapiens
  Payload ID: 2586
  Gene Symbol: CD81
  Gene Name: CD81 molecule
  ENST ID: ENST00000493525
  CDS Start-End: 100-396
gtctgtgcacccgtgccgtggcgtgcccgtcgtctgtgcacccgtgctgtggtgtgcccttcgtctgttccttttattgccgggcagggttgcacccacatgtgcaagccagcgacggaccccaggttcacccgttcaccgctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggcc

SEQ ID NO: 115741 - DNA, 558 bp, Homo sapiens
  Payload ID: 2586
  Gene Symbol: CD81
  Gene Name: CD81 molecule
  ENST ID: ENST00000530648
  CDS Start-End: 404-558
agtacccagtagtcatctgtgccagggggttatccaggtacagaacattcccatcgttgcagaaggttctatcagctagcactgggttggacgacacttgccaagacgagctggctagaggatggttctccggacctggtcccacgtggttcccaggttccagccccggagagcaatgtgagcaaagcttgctgtctttgcaaagccaaccactgtggcatcaactccttcaggaagccctcccggattgtccaagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgt

SEQ ID NO: 115742 - DNA, 606 bp, Homo sapiens
  Payload ID: 2586
  Gene Symbol: CD81
  Gene Name: CD81 molecule
  ENST ID: ENST00000475945
  CDS Start-End: 329-606
tttggttccttgtggccacatttccagtacccagtagtcatctgtgccagggggttatccaggtacagaacattcccatcgttgcagaaggttctatcagctagcactgggttggacgacacttgccaagacgagctggctagaggatggttctccggacctggtcccacgtggttcccagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgc

SEQ ID NO: 115743 - DNA, 720 bp, Homo sapiens
  Payload ID: 2586
  Gene Symbol: CD81
  Gene Name: CD81 molecule
  ENST ID: ENST00000527343
  CDS Start-End: 1-678
ggtgggagcaggtggcagagaggcttcccacagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccct

SEQ ID NO: 115744 - DNA, 794 bp, Homo sapiens
  Payload ID: 2586
  Gene Symbol: CD81
  Gene Name: CD81 molecule
  ENST ID: ENST00000464784
  CDS Start-End: 1-665
ggcagagaggcttcccacagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatggtgagcgggcgggggcggagggcctgctctctgggctgccccttccgcggggccttgtgctgactgcgccccccaccaccctcctgcagatcttcgagatgatcctgagcatggtgctgtgctgtggcatccggaacagctccgtgtactgaggccccgcagctctggccacagggacctctgcagtgcccc

SEQ ID NO: 115745 - DNA, 444 bp, Homo sapiens
  Payload ID: 2586
  Gene Symbol: CD81
  Gene Name: CD81 molecule
  ENST ID: ENST00000533417
  CDS Start-End: 1-444
cagacacaggatgtccctctgccagcccctgaagccccgtcccctgacgagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacg

SEQ ID NO: 115746 - DNA, 886 bp, Homo sapiens
  Payload ID: 2586
  Gene Symbol: CD81
  Gene Name: CD81 molecule
  ENST ID: ENST00000492627
  CDS Start-End: 239-736
tgtgctctcccaccacgtttggaaagttactgcttccctcttcctcagcccctcgggctcccagttatggaagtggcgtgattcagagaagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttc

SEQ ID NO: 115747 - DNA, 2289 bp, Homo sapiens
  Payload ID: 2587
  Gene Symbol: CD82
  Gene Name: CD82 molecule
  Uniprot ID: P27701
  ENST ID: ENST00000227155
  CDS Start-End: 249-1052
ggcctgccgagtccgcggcgttccccggctgcagccgggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccatcctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtcta

SEQ ID NO: 115748 - DNA, 967 bp, Homo sapiens
  Payload ID: 2587
  Gene Symbol: CD82
  Gene Name: CD82 molecule
  Uniprot ID: P27701
  ENST ID: ENST00000342935
  CDS Start-End: 239-967
gtccgcggcgttccccggctgcagccgggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactga

SEQ ID NO: 115749 - DNA, 580 bp, Homo sapiens
  Payload ID: 2587
  Gene Symbol: CD82
  Gene Name: CD82 molecule
  ENST ID: ENST00000532544
  CDS Start-End: 257-580
gagtgactgagccccgggctgtgcagtccgacgccgactgaggcacgagcgggtgacgctgggcctgcagcgcggagcagaaagcagaacccgcagttcaactgagccggaccccctaagacttcaagttggaaactcagtggggcttttccagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttc

SEQ ID NO: 115750 - DNA, 757 bp, Homo sapiens
  Payload ID: 2587
  Gene Symbol: CD82
  Gene Name: CD82 molecule
  ENST ID: ENST00000524750
  CDS Start-End: 1-174
gacaacagcctttctgtgaggaagggcttctgcgaggcccccggcaacaggacccagagtggcaaccaccctgaggactggcctgtgtaccaggagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccatcctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtga

SEQ ID NO: 115751 - DNA, 654 bp, Homo sapiens
  Payload ID: 2587
  Gene Symbol: CD82
  Gene Name: CD82 molecule
  ENST ID: ENST00000527737
  CDS Start-End: 118-654
gaggcacgagcgggtgacgctgggcctgcagcgcggagcagaaagcagaacccgcagccccttacccaggagcagcagtggtcatcttctggcacggagcctctccaggatgggcacatggctagagactggatcaggcctcagagggcttcagactgttggtcaggaaagcaacaacttttccagatcatcatcatcatcatcataagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaaggtaagcccc

SEQ ID NO: 115752 - DNA, 581 bp, Homo sapiens
  Payload ID: 2587
  Gene Symbol: CD82
  Gene Name: CD82 molecule
  ENST ID: ENST00000530601
  CDS Start-End: 109-581
agtgggcttccatcaaataactactcaaatgcatgaaaaattgcagttgttgggggtactaggaacagataggctcttcggaaagcagatgaggctcttggcctggtcatggagatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcga

SEQ ID NO: 115753 - DNA, 573 bp, Homo sapiens
  Payload ID: 2587
  Gene Symbol: CD82
  Gene Name: CD82 molecule
  ENST ID: ENST00000525813
  CDS Start-End: 260-573
aagcctcccagggcgtggcgtgaagcggggatttggtaggggagcgcagagcgaggcctgaggtgtttccctggcagaggtccctccactgggaaacaaacggagaggggagtatgtgttcccacgtgtacacataaaccgttttgaatgatacctgagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccct

SEQ ID NO: 115754 - DNA, 468 bp, Homo sapiens
  Payload ID: 2587
  Gene Symbol: CD82
  Gene Name: CD82 molecule
  ENST ID: ENST00000525210
  CDS Start-End: 354-468
gcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaagcatttagagtcctggagtgctggtccctggggaggctcggcagcaggtcctggcattcagagctggcccagggttgagcacctgacacacccccaacctgccctgcgggcaaggacagaagaggcctgagaaccgtctcttcggactcaggggcagtggaactcagactgccttcaggaagctccaggactggcgggatgggctcagcctgtatcaaagtcaccaaatactttctcttcctcttcaacttgatcttctttatcctgggcgcagtgatcctgggcttcggggtgtggatcctggccgacaaga

SEQ ID NO: 115755 - DNA, 538 bp, Homo sapiens
  Payload ID: 2587
  Gene Symbol: CD82
  Gene Name: CD82 molecule
  ENST ID: ENST00000526958
  CDS Start-End: 56-538
gtgagaggacattgtgataatggaagtgaaagagctttgtcagctgcacaggtgaatgcccctggtcattaaccagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatc

SEQ ID NO: 115756 - DNA, 584 bp, Homo sapiens
  Payload ID: 2587
  Gene Symbol: CD82
  Gene Name: CD82 molecule
  ENST ID: ENST00000524704
  CDS Start-End: 381-584
agcagaacccgcaggtgagcaagggggcagcgggccggggtagcctgccggacaaccataggcaaagttagttttagcccccgcttctgcggtccggctcggacaactttcctcggaactagtgacaggtcggggcagctggtgggtgaaaaggagctttagccaccagtcctgaacccccagttctcacactcggccgtgcacagctgcgtgatcctgggtccgtccctctacctggctctggacctcccgggttccagcaggaggaagtgaaccagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctc

SEQ ID NO: 115757 - DNA, 2471 bp, Homo sapiens
  Payload ID: 2588
  Gene Symbol: CD83
  Gene Name: CD83 molecule
  Uniprot ID: Q01151
  ENST ID: ENST00000379153
  CDS Start-End: 172-789
gcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaatgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaa

SEQ ID NO: 115758 - DNA, 2307 bp, Homo sapiens
  Payload ID: 2588
  Gene Symbol: CD83
  Gene Name: CD83 molecule
  ENST ID: ENST00000612003
  CDS Start-End: 185-625
gattatcacagattctggagaagagtgaggacttgggttcaccacctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaatgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaa

SEQ ID NO: 115759 - DNA, 1116 bp, Homo sapiens
  Payload ID: 2589
  Gene Symbol: CD84
  Gene Name: CD84 molecule
  Uniprot ID: Q9UIB8
  ENST ID: ENST00000311224
  CDS Start-End: 68-1105
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtaggattttcccagaaggttcctgcttgaacaccttcactaagaacccttatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggct

SEQ ID NO: 115760 - DNA, 1098 bp, Homo sapiens
  Payload ID: 2589
  Gene Symbol: CD84
  Gene Name: CD84 molecule
  Uniprot ID: Q9UIB8
  ENST ID: ENST00000368048
  CDS Start-End: 68-1087
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggttcctgcttgaacaccttcactaagaacccttatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggct

SEQ ID NO: 115761 - DNA, 965 bp, Homo sapiens
  Payload ID: 2589
  Gene Symbol: CD84
  Gene Name: CD84 molecule
  Uniprot ID: Q9UIB8
  ENST ID: ENST00000368051
  CDS Start-End: 68-886
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtgcttccctccaaggaagagccagtgaacacagtttattccgaagtgcagtttgctgataagatggggaaagccagcacacaggacagtaaacctcctgggacttcaagctatgaaattgtgatctaggctgctggg

SEQ ID NO: 115762 - DNA, 8181 bp, Homo sapiens
  Payload ID: 2589
  Gene Symbol: CD84
  Gene Name: CD84 molecule
  Uniprot ID: Q9UIB8
  ENST ID: ENST00000368054
  CDS Start-End: 37-1023
ccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaagatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgccctcaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaatcccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagacagagtgagactccatctcgaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaaaccccatctgtacttaaaatacaaaaaaattagctgggcgtggtggtgcacacctgtaatcccagctacttgggaggctgaggtgggagaattgcttgaacctgggaggtggaggttgcagtgagctgagatcctgccactgcactccaggctgggcaacagagtgagaccatgtctcaaaaaataaaaataaaataaaataatatcaggatgcatacatcagaggctgttcctagtgtaaaggcactttggagggagaagactttcagagttaggcagaccaactaagaggtcagctgaagcacctaaccagttgtaaggaggtgaaagacagcaccccaagaagagacgtgcaggaaggaggaaagaggcttggtcataaaggatggaggaattccaaagtgacactgaacaggctgcgtttatcctaaaataaaaccactcctcactctgtggatgcgttgaagactcattcccaaacatctttattctctaacttgccctcttcctcttcctaatatgctcactcaagtaaaattactagtgtcctaatgcccctatgcatattgtcaaaaataaaaatcagaagcaggttagatctgttaggtcttccagaagagcaaacctgggatgaagccagagcccaggaattctgaaggtagcctttggactcaggacaccctactcttgtctctcctctcagtttctctgctatgaatctcctgattcatgaacacgttatctgttcacccttctctctaggtcttagttcttagattttccttctgtaaaatgcatgtgatcttattttcccctccacaactttccagatgaactagactgtgaccaagaggtctataaaatcaaagcatcatggaacaggatcttgtatcagaccaaagtgtgccagtttttaaaaatgtgcatcaaaatggaagtctcagagacagagccctctggtggaaagttctagtaggttaggacagtcctgcctgcagacaccttgggctttactgagggactcaactgagaaaatgaggaatgttgcagctcatgattcttagaagaagaaagtgaagcttgtttaaaatatgatttaaaaaatctgtagaacactgtaaactacacaggctatgagggaatagcctggttgggccagcttggaaatcgggcacaggcaggaaggggcctgtctggtttgggccgtgtccacagagagcacttcttaggtcctgcctggagagaaggaatggctgggctatattttcttccagactcattatttttcttctgtttgacttttctctgaatttcccttgatttgtataaattttctcaataattagtgacagtgtctactgattgtaaaatgaagcttgaaggccaggcgcagtggctcatgcctgtaatcctagaattttgggaggccaaggtgggtggatcacaaggagttcgagaccagcctggccaaggttgtgaaaccgcgtctctactaaaaatacaaaaaaattagccgggcatggtggcacgtgcctgtagtcccagctactcaggaagctgaggcaacagaatcacttgaacctgggaggtggaggttgcagtgagccgagatcacgccactgcactccagcctgggcgagagagtgagactccgtctcaaaaaaaaaaaaaaaaaaaaaagtttgaagaacaaagacaataagaggaaatataatgagtggtcataaatgtgggctctgacagtagagtgcctgggtctgcatcctggtttcttagtcatgtgaccttaggcaagttactttaacctcgctgtacctcaggttgtccatctgtaaaatggggataataatagtgcctaccttttaaggttgatgtggggattaaatgaggtgttgctcatacaggaatgtgcctgtgcatggcaaagttcgggaaattttttataagctgttctaggcctgaaatcttcagaagatgctaatctaaattcatgaaataagcttcttacaacagaaatgctgctagtattatgcaaaattaatgttgtatatcaaacttttaactctcatccctccttattcagatatattttgttataagcaatgtttgttcccctcgttattataccacagtctacttacctgatgctatatctgcctccccagttagactgagagaacaggggatatacctaaataataataataataataataataataaataataatggagagctccttgaagatagggagcctgtaagaatcattgagggcttattttgtataccaactgctaaactagatgcttcatacattgttgtcaatactcatgacagccttgtaaagtagaaattaattcttccagttaacactaaggctgacatatgaataccttggcaaatctggaaagctgggaagacagtatttgaattcaagacttcttgtcaccaagggccatgcacttgtactctgccatgtggcccttttttacctcctgtggattctccctacctggtacttggccttaggtgtacacacacctggcactttgcttgacacataataggtggaccacaaatatctactaaatgaatatttgcatatagtaatattttaaggtactaaaagcagctcaaagtaaatatattaatatattaattccattgctatctggataaccactcaactttcctgctgaaaatgcccatttaattaaagaaggttggatagagctctctatatgcattttggacaggcaggggtttcaggtcataaacattctgatgagttaatataaaataagagaaactgtaaatttccactactaaaaatcacaaaaataacagaaacaaaagaagagataagaatttggggaattgtgctgaacaatttagtggttaaaaaaaacaactgtgcatgtttagacttaaataagcccccatccaagtgtgaggggtccagtaatttttcaaaacatatgaaagtgttaatacatttcgacaaaggaccattaaaaaagtcctgaattctgacttgagggaggaaagtaatgactaatacattctctagagacttgcagactttgggaattcataaaggaatggatgataattattaactgttgctggctgattgcccagacagttctcaacagccctgtacaagtctctgggtttgggatggatcaattctgagactggaaaatggccaaatctttgcaaatgagaaatatttttcttataagttcttattgtaggcaaataattacatagattattcatcagagaatttttaaatgctcataatctcaactctttcatttacaacttgtatttccaatagtttatgggtcatctctgcatagatgtcagaagtcacctcaagtttagcgtgtccaaaatctaactcacaggtctgtttctgacctcccaacttgctttccttgtgtttttcctatgctaatgatccaccataatcaaaataattaacatttatccagtgcctactatgtactattccctgtcctgttttacatttactcatttaaagtccataagaaacattaaatctcatctgccttctgaagaagatacaaccatgctctcttttacaaagtaggaaactgggtcacagaaaggtgaagtctttaaggctgaatcacagtagctcatcctagtaaatagaaaagccaggattcaactccaggggctgggtgcagaactgctattcttcactgcttcaccaatcagcagctacccaaggcagaaaactttttcatccttggctccttcattctccctgtcaccccagatcccctctacatctagtcagagaataggtcctgtcaattccaacttctctatatggctcctctcaggcatgtgcccttaattggcctaattctctaatacaccttccctctacatgctcactccctcagatcattgctttatcacgtgttacctgggttgctattacataaagagcaatctttctaaaatgaggatcttatcacttcacttccacactaaaatgtttttcctggggaaccacactccttagcaatctgacccatcagaccttccaggctgtctcctgcctgctccctaaggctccagccacacagaattatcatgggcccacacacccaccaaatcctcccatgcctttgcccatgttgtctgggatgcccttctctcccttctgtctacatcaagcatcagactgaatatccctcttgtgcggccttctaaaacctcccgtccaaagcgaaatatattgccctctatttatacttttacagcatttggcacacaagtacagagtagtagctttttatcacattctctgataattatatagatatggtatttcttagctctctctccaactggctaataagttgctttttgtctgagtgcctaattttgtgttttgtgtctgagtgcctcagttcctcaaaaaaaggttttttgattagttcattattcatttgaacatggaaattatgctcactagtggcaaatgccactaaccgtattccagaagctaggtgtcatgtttgcaataagatatattatcccttctacaagtcaccttttatttcaggcatttgtaaatgcccattaataaagtatggttcataaattttaccttgtaagtgcctaagaaatgagactacaagctccatttcagcaggacacaataaatattattttataatgca

SEQ ID NO: 115763 - DNA, 7885 bp, Homo sapiens
  Payload ID: 2589
  Gene Symbol: CD84
  Gene Name: CD84 molecule
  Uniprot ID: Q9UIB8
  ENST ID: ENST00000534968
  CDS Start-End: 80-724
ggaggaagaaaactcaagtgaaactgactctgctagaacagtgccgtgcttttccacagaaggttagaccctgaaagagatggctcagcaccacctatggatcttgctcctttgcctgcaaacctgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaagatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgccctcaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaatcccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagacagagtgagactccatctcgaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaaaccccatctgtacttaaaatacaaaaaaattagctgggcgtggtggtgcacacctgtaatcccagctacttgggaggctgaggtgggagaattgcttgaacctgggaggtggaggttgcagtgagctgagatcctgccactgcactccaggctgggcaacagagtgagaccatgtctcaaaaaataaaaataaaataaaataatatcaggatgcatacatcagaggctgttcctagtgtaaaggcactttggagggagaagactttcagagttaggcagaccaactaagaggtcagctgaagcacctaaccagttgtaaggaggtgaaagacagcaccccaagaagagacgtgcaggaaggaggaaagaggcttggtcataaaggatggaggaattccaaagtgacactgaacaggctgcgtttatcctaaaataaaaccactcctcactctgtggatgcgttgaagactcattcccaaacatctttattctctaacttgccctcttcctcttcctaatatgctcactcaagtaaaattactagtgtcctaatgcccctatgcatattgtcaaaaataaaaatcagaagcaggttagatctgttaggtcttccagaagagcaaacctgggatgaagccagagcccaggaattctgaaggtagcctttggactcaggacaccctactcttgtctctcctctcagtttctctgctatgaatctcctgattcatgaacacgttatctgttcacccttctctctaggtcttagttcttagattttccttctgtaaaatgcatgtgatcttattttcccctccacaactttccagatgaactagactgtgaccaagaggtctataaaatcaaagcatcatggaacaggatcttgtatcagaccaaagtgtgccagtttttaaaaatgtgcatcaaaatggaagtctcagagacagagccctctggtggaaagttctagtaggttaggacagtcctgcctgcagacaccttgggctttactgagggactcaactgagaaaatgaggaatgttgcagctcatgattcttagaagaagaaagtgaagcttgtttaaaatatgatttaaaaaatctgtagaacactgtaaactacacaggctatgagggaatagcctggttgggccagcttggaaatcgggcacaggcaggaaggggcctgtctggtttgggccgtgtccacagagagcacttcttaggtcctgcctggagagaaggaatggctgggctatattttcttccagactcattatttttcttctgtttgacttttctctgaatttcccttgatttgtataaattttctcaataattagtgacagtgtctactgattgtaaaatgaagcttgaaggccaggcgcagtggctcatgcctgtaatcctagaattttgggaggccaaggtgggtggatcacaaggagttcgagaccagcctggccaaggttgtgaaaccgcgtctctactaaaaatacaaaaaaattagccgggcatggtggcacgtgcctgtagtcccagctactcaggaagctgaggcaacagaatcacttgaacctgggaggtggaggttgcagtgagccgagatcacgccactgcactccagcctgggcgagagagtgagactccgtctcaaaaaaaaaaaaaaaaaaaaaagtttgaagaacaaagacaataagaggaaatataatgagtggtcataaatgtgggctctgacagtagagtgcctgggtctgcatcctggtttcttagtcatgtgaccttaggcaagttactttaacctcgctgtacctcaggttgtccatctgtaaaatggggataataatagtgcctaccttttaaggttgatgtggggattaaatgaggtgttgctcatacaggaatgtgcctgtgcatggcaaagttcgggaaattttttataagctgttctaggcctgaaatcttcagaagatgctaatctaaattcatgaaataagcttcttacaacagaaatgctgctagtattatgcaaaattaatgttgtatatcaaacttttaactctcatccctccttattcagatatattttgttataagcaatgtttgttcccctcgttattataccacagtctacttacctgatgctatatctgcctccccagttagactgagagaacaggggatatacctaaataataataataataataataataataaataataatggagagctccttgaagatagggagcctgtaagaatcattgagggcttattttgtataccaactgctaaactagatgcttcatacattgttgtcaatactcatgacagccttgtaaagtagaaattaattcttccagttaacactaaggctgacatatgaataccttggcaaatctggaaagctgggaagacagtatttgaattcaagacttcttgtcaccaagggccatgcacttgtactctgccatgtggcccttttttacctcctgtggattctccctacctggtacttggccttaggtgtacacacacctggcactttgcttgacacataataggtggaccacaaatatctactaaatgaatatttgcatatagtaatattttaaggtactaaaagcagctcaaagtaaatatattaatatattaattccattgctatctggataaccactcaactttcctgctgaaaatgcccatttaattaaagaaggttggatagagctctctatatgcattttggacaggcaggggtttcaggtcataaacattctgatgagttaatataaaataagagaaactgtaaatttccactactaaaaatcacaaaaataacagaaacaaaagaagagataagaatttggggaattgtgctgaacaatttagtggttaaaaaaaacaactgtgcatgtttagacttaaataagcccccatccaagtgtgaggggtccagtaatttttcaaaacatatgaaagtgttaatacatttcgacaaaggaccattaaaaaagtcctgaattctgacttgagggaggaaagtaatgactaatacattctctagagacttgcagactttgggaattcataaaggaatggatgataattattaactgttgctggctgattgcccagacagttctcaacagccctgtacaagtctctgggtttgggatggatcaattctgagactggaaaatggccaaatctttgcaaatgagaaatatttttcttataagttcttattgtaggcaaataattacatagattattcatcagagaatttttaaatgctcataatctcaactctttcatttacaacttgtatttccaatagtttatgggtcatctctgcatagatgtcagaagtcacctcaagtttagcgtgtccaaaatctaactcacaggtctgtttctgacctcccaacttgctttccttgtgtttttcctatgctaatgatccaccataatcaaaataattaacatttatccagtgcctactatgtactattccctgtcctgttttacatttactcatttaaagtccataagaaacattaaatctcatctgccttctgaagaagatacaaccatgctctcttttacaaagtaggaaactgggtcacagaaaggtgaagtctttaaggctgaatcacagtagctcatcctagtaaatagaaaagccaggattcaactccaggggctgggtgcagaactgctattcttcactgcttcaccaatcagcagctacccaaggcagaaaactttttcatccttggctccttcattctccctgtcaccccagatcccctctacatctagtcagagaataggtcctgtcaattccaacttctctatatggctcctctcaggcatgtgcccttaattggcctaattctctaatacaccttccctctacatgctcactccctcagatcattgctttatcacgtgttacctgggttgctattacataaagagcaatctttctaaaatgaggatcttatcacttcacttccacactaaaatgtttttcctggggaaccacactccttagcaatctgacccatcagaccttccaggctgtctcctgcctgctccctaaggctccagccacacagaattatcatgggcccacacacccaccaaatcctcccatgcctttgcccatgttgtctgggatgcccttctctcccttctgtctacatcaagcatcagactgaatatccctcttgtgcggccttctaaaacctcccgtccaaagcgaaatatattgccctctatttatacttttacagcatttggcacacaagtacagagtagtagctttttatcacattctctgataattatatagatatggtatttcttagctctctctccaactggctaataagttgctttttgtctgagtgcctaattttgtgttttgtgtctgagtgcctcagttcctcaaaaaaaggttttttgattagttcattattcatttgaacatggaaattatgctcactagtggcaaatgccactaaccgtattccagaagctaggtgtcatgtttgcaataagatatattatcccttctacaagtcaccttttatttcaggcatttgtaaatgcccattaataaagtatggttcataaattttaccttgtaagtgcctaagaaatgagactacaagctccatttcagcaggacacaataaatattattttataatgcatct

SEQ ID NO: 115764 - DNA, 2634 bp, Homo sapiens
  Payload ID: 2590
  Gene Symbol: CD86
  Gene Name: CD86 molecule
  Uniprot ID: P42081
  ENST ID: ENST00000264468
  CDS Start-End: 202-1029
ccctttctgtatttgagttctaccgtcagtcctggcattatttctctctctacaaggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctataggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattcattt

SEQ ID NO: 115765 - DNA, 2708 bp, Homo sapiens
  Payload ID: 2590
  Gene Symbol: CD86
  Gene Name: CD86 molecule
  Uniprot ID: P42081
  ENST ID: ENST00000330540
  CDS Start-End: 117-1106
ggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattca

SEQ ID NO: 115766 - DNA, 1405 bp, Homo sapiens
  Payload ID: 2590
  Gene Symbol: CD86
  Gene Name: CD86 molecule
  Uniprot ID: P42081
  ENST ID: ENST00000393627
  CDS Start-End: 148-1119
aggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaata

SEQ ID NO: 115767 - DNA, 891 bp, Homo sapiens
  Payload ID: 2590
  Gene Symbol: CD86
  Gene Name: CD86 molecule
  ENST ID: ENST00000478741
  CDS Start-End: 1-832
cactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctataggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcct

SEQ ID NO: 115768 - DNA, 1604 bp, Homo sapiens
  Payload ID: 2590
  Gene Symbol: CD86
  Gene Name: CD86 molecule
  Uniprot ID: P42081
  ENST ID: ENST00000469710
  CDS Start-End: 321-1064
attgccgaggaaggcttgcacagggtgaaagctttgcttctctgctgctgtaacagggactagcacagacacacggatgagtggggtcatttccagatattaggtcacagcagaagcagccaaaatggatccccagtggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctag

SEQ ID NO: 115769 - DNA, 567 bp, Homo sapiens
  Payload ID: 2590
  Gene Symbol: CD86
  Gene Name: CD86 molecule
  ENST ID: ENST00000482356
  CDS Start-End: 65-567
gtatttgagttctaccgtcagtcctggcattatttctctctctacaaggagccttaggagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaag

SEQ ID NO: 115770 - DNA, 1572 bp, Homo sapiens
  Payload ID: 2590
  Gene Symbol: CD86
  Gene Name: CD86 molecule
  Uniprot ID: P42081
  ENST ID: ENST00000493101
  CDS Start-End: 125-778
attgccgaggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctctt

SEQ ID NO: 115771 - DNA, 2873 bp, Homo sapiens
  Payload ID: 2591
  Gene Symbol: CD8A
  Gene Name: CD8a molecule
  Uniprot ID: P01732
  ENST ID: ENST00000283635
  CDS Start-End: 856-1563
gaatttccatccagcaatgcaggccatgggaggctgcagcagtgacgctgtcagatcccctttgtgagaataataatttttataacaacgtggctggaggactgatcaggagagagactggtgtgaattgaaggctgttgcaatggctccaagaagagatgaggctgtgtggtgagtttagccgctggatgaaaggccggaagaatgaggtcagcagcgcactgacaccgacacccaaagcttcggctgctgccgctctcatggaaatctcctgggggaagggagagggtccttcctcggtgaaaactggggctgctctagcgagttcctcagaagcgggcaggtcgctagttcctcttccttttcagccctcagtgcccattttgccaataaaaagtcccaaggtgacagtacaagagacgcctttagtgaaggcaaaggaagggacactcccctcctttgctgcctactctcgccctcacttcttgaaatctttggtctcccttcacccactctgtcactctcacaagacaaccatttccaaggactatttccaagcccttttcctcatccccaaacccgcagttttcagctgcccccagttgcctggccaggctgcctcgacggccctattcacgggccccagcctcctcgccgggctggaaggcgacaaccgcgaaaaggagggtgactctcctcggcgggggcttcgggtgacatcacatcctccaaatgcgaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagca

SEQ ID NO: 115772 - DNA, 1977 bp, Homo sapiens
  Payload ID: 2591
  Gene Symbol: CD8A
  Gene Name: CD8a molecule
  Uniprot ID: P01732
  ENST ID: ENST00000352580
  CDS Start-End: 71-667
ccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagca

SEQ ID NO: 115773 - DNA, 3048 bp, Homo sapiens
  Payload ID: 2591
  Gene Symbol: CD8A
  Gene Name: CD8a molecule
  Uniprot ID: P01732
  ENST ID: ENST00000409511
  CDS Start-End: 1032-1739
ctctgtaaaataaatgcgctgggccggatcttttctgagttctcttctcccctacgaattctagatccctcctctgtcctccctgcgccagggaccttcgggcgacccttccctgtacccccaccccaccctctctggaccccgtttctgcctcagtacggcgcgctgagctctgccccctgcccaggccctgaccccctcaggagccgcggtttcctggggtaacagtgggaaacgtgtcggccgtctccgctcaggcgcttgctgtgtacagaaaggctgattcaggcacaccggctctcgtcgccttggtggccctccccagccctcctccgcgcctgctccgggtggcgctccgctgggctcctcgtgcgcctgtccgcgaccgcacccacctcatcctggcacccccatcgtggcatcacgtgttccctcatctgtcctcatggctggcgtgcccctctgcggtgagacctgcagaacaggaattggtgccgggtcagcagccggcgatgaagccggacgaagcctgcaaaccccacccatacgccagcttcacatagctcctatccattgcacagcagcgtggggaagcaccgttctctaccctccaaacaaaagcatgaaccaggtgcagtggctcacgtctgtaatcccagcattttggaggccaaggtggatggatggattccttgagtccaggagttcaagaccagcctgggcaacatggtgaacccccatctctacaaaaatttagccagttttcagctgcccccagttgcctggccaggctgcctcgacggccctattcacgggccccagcctcctcgccgggctggaaggcgacaaccgcgaaaaggagggtgactctcctcggcgggggcttcgggtgacatcacatcctccaaatgcgaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagc

SEQ ID NO: 115774 - DNA, 597 bp, Homo sapiens
  Payload ID: 2591
  Gene Symbol: CD8A
  Gene Name: CD8a molecule
  ENST ID: ENST00000409781
  CDS Start-End: 1-597
atggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaa

SEQ ID NO: 115775 - DNA, 832 bp, Homo sapiens
  Payload ID: 2592
  Gene Symbol: CD8B
  Gene Name: CD8b molecule
  Uniprot ID: P10966
  ENST ID: ENST00000331469
  CDS Start-End: 51-782
gcgactgtctccgccgagcccccggggccaggtgtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacagcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagatt

SEQ ID NO: 115776 - DNA, 849 bp, Homo sapiens
  Payload ID: 2592
  Gene Symbol: CD8B
  Gene Name: CD8b molecule
  Uniprot ID: P10966
  ENST ID: ENST00000349455
  CDS Start-End: 51-692
gcgactgtctccgccgagcccccggggccaggtgtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggccggcggaggagagcccggcttcgtttcatgaaacagcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagattcctccctcgctcagagggatcctcccacacacccagcagagacttctctgccaccatcaaccccccaagtcatagggggctcaagttctgccctggtgagctgtggc

SEQ ID NO: 115777 - DNA, 1417 bp, Homo sapiens
  Payload ID: 2592
  Gene Symbol: CD8B
  Gene Name: CD8b molecule
  Uniprot ID: P10966
  ENST ID: ENST00000390655
  CDS Start-End: 60-692
accccagccgcgactgtctccgccgagcccccggggccaggtgtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaattttacaaatgagcagagaatacggttttggtgtcctgctacaaaaagacatcggtcagtaacgagcacgatgtggaaaaatgagagaagggacacattcaaccctggagagttcaatggctgctgaagctgcctgcttttcactgctgcaaggcctttctgtgtgtgatgtgcatgggagcaacttgttcgtgggtcatcgggaatactagggagaaggtttcattgcccccagggcacttcacagagtgtgctggaggactgagtaagaaatgctgcccatgccaccgcttccggctcctgtgctttccctgaactgggacctttagtggtggccatttagccaccatctttgcaggttgctttgccctggtagggcagtaacattgggtcctgggtctttcatggggtgatgctgggctggctccctcttggtcttcccaggctggggctgaccttcctcgcagagaggccaggtgcaggttgggaatgaggcttgctgagaggggctgtccagttcccagaaggcatatcagtctctgagggcttcctttggggccgggaacttgcgggtttgaggataggagttcacttcatcttctcagctcccatttctactcttaagtttctcagctcccatttctactctcccatggcttaatgcttctttcattttctgtttgttttatacaaatgtcttagttgtacaaataaagtcccaggttaaagataacaaa

SEQ ID NO: 115778 - DNA, 1096 bp, Homo sapiens
  Payload ID: 2592
  Gene Symbol: CD8B
  Gene Name: CD8b molecule
  Uniprot ID: P10966
  ENST ID: ENST00000393759
  CDS Start-End: 51-716
gcgactgtctccgccgagcccccggggccaggtgtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaactaagattacatccactggagaaatgttccagaatggactactgaatatacaggcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagattcctccctcgctcagagggatcctcccacacacccagcagagacttctctgccaccatcaaccccccaagtcatagggggctcaagttctgccctggtgagctgtggcccccatccttgtgaaccccaaagtgtcccccttgtggaaccaaatgtatccatcttgaataaatttgcccaaaatcctaaagaccgggaaaagggaaccattg

SEQ ID NO: 115779 - DNA, 932 bp, Homo sapiens
  Payload ID: 2592
  Gene Symbol: CD8B
  Gene Name: CD8b molecule
  Uniprot ID: P10966
  ENST ID: ENST00000393761
  CDS Start-End: 60-656
accccagccgcgactgtctccgccgagcccccggggccaggtgtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagattcctccctcgctcagagggatcctcccacacacccagcagagacttctctgccaccatcaaccccccaagtcatagggggctcaagttctgccctggtgagctgtggcccccatccttgtgaaccccaaagtgtcccccttgtggaaccaaatgtatccatcttgaataaatttgcccaaaatcctaaagaccgggaaaagggaaccattgagcttggc

SEQ ID NO: 115780 - DNA, 692 bp, Homo sapiens
  Payload ID: 2592
  Gene Symbol: CD8B
  Gene Name: CD8b molecule
  ENST ID: ENST00000431506
  CDS Start-End: 60-692
accccagccgcgactgtctccgccgagcccccggggccaggtgtcccgggcgcgccacgatgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaactgtataaatag

SEQ ID NO: 115781 - DNA, 1169 bp, Homo sapiens
  Payload ID: 2593
  Gene Symbol: CD9
  Gene Name: CD9 molecule
  Uniprot ID: P21926
  ENST ID: ENST00000009180
  CDS Start-End: 52-738
cgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatg

SEQ ID NO: 115782 - DNA, 1229 bp, Homo sapiens
  Payload ID: 2593
  Gene Symbol: CD9
  Gene Name: CD9 molecule
  ENST ID: ENST00000382515
  CDS Start-End: 319-798
gtggggagccgggccctcttgagatgaggcgtgcgggagggtcctgagcactttagctcgcctaggatttgagctggggtgtgtgtctgctcccagctcaagtccctccgagtgccagagaggaaggcagggagaagcggagcacccctctttgggccaaggccaaggaggactgtgcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatg

SEQ ID NO: 115783 - DNA, 1556 bp, Homo sapiens
  Payload ID: 2593
  Gene Symbol: CD9
  Gene Name: CD9 molecule
  Uniprot ID: P21926
  ENST ID: ENST00000382518
  CDS Start-End: 437-1123
ctgcccagccctcagctgtgttattattcggtgataggtatttgctaattacttccaaaagcctcccatctgtcatcccacccagactgcgcgcttctaattcctcctaccccacatgctgtgcccaatgaaaagtatggtcagcgagcgaaggtttgcaaggagacagacgagggcgaaattaagccaggcggcttccctttaaatcctcgcaaagcagaagggcccctcactctggcagcaggccttggccaaggggcctttagccctgacgacccggggaagagtctcccaaagcagaacgcccggtccggcgcccagaccaaacgcgggggaaccggaagggcgaggcctccaccgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtc

SEQ ID NO: 115784 - DNA, 800 bp, Homo sapiens
  Payload ID: 2593
  Gene Symbol: CD9
  Gene Name: CD9 molecule
  ENST ID: ENST00000382519
  CDS Start-End: 116-800
cggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactggcaactaaaaggactatgtttcccccttttctcgaggaccacgtttgctttttttccctgaatccacagttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtgg

SEQ ID NO: 115785 - DNA, 739 bp, Homo sapiens
  Payload ID: 2593
  Gene Symbol: CD9
  Gene Name: CD9 molecule
  ENST ID: ENST00000536586
  CDS Start-End: 315-739
aggagacagacgagggcgaaattaagccaggcggcttccctttaaatcctcgcaaagcagaagggcccctcactctggcagcaggccttggccaaggggcctttagccctgacgacccggggaagagtctcccaaagcagaacgcccggtccggcgcccagaccaaacgcgggggaaccggaagggcgaggcctccacccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaac

SEQ ID NO: 115786 - DNA, 1315 bp, Homo sapiens
  Payload ID: 2593
  Gene Symbol: CD9
  Gene Name: CD9 molecule
  ENST ID: ENST00000610354
  CDS Start-End: 185-733
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcggttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggactggt

SEQ ID NO: 115787 - DNA, 1229 bp, Homo sapiens
  Payload ID: 2593
  Gene Symbol: CD9
  Gene Name: CD9 molecule
  ENST ID: ENST00000617871
  CDS Start-End: 112-657
gaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaacctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtc

SEQ ID NO: 115788 - DNA, 6708 bp, Homo sapiens
  Payload ID: 2594
  Gene Symbol: CD93
  Gene Name: CD93 molecule
  Uniprot ID: Q9NPY3
  ENST ID: ENST00000246006
  CDS Start-End: 149-2107
aaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccagccgcctccccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgtgctgcaacagccagtcccacaaggggccccgagggcacccccaaggctacacccaccacaagtagaccttcgctgtcatctgacgcccccatcacatctgccccactcaagatgctggcccccagtgggtccccaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggccggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgtagtcgatagtgtgcactctttctctctctctctctctctcacacacacacacacacacacacacacacacacagagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaaagggtgtttctggttttgccttagcaatgcatcggtctctgaggtgacactctggagtggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcatctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaatgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacacattgattgtgaa

SEQ ID NO: 115789 - DNA, 4324 bp, Homo sapiens
  Payload ID: 2595
  Gene Symbol: CD96
  Gene Name: CD96 molecule
  Uniprot ID: P40200
  ENST ID: ENST00000283285
  CDS Start-End: 132-1889
ataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacgttacagcagatgaatggaacagcaaccatacgatagaaatagagataaatcagactctggaaataccatgctttcaaaatagctcctcaaaaatttcatctgagttcacctatgcatggtcggtggaaaacagcagcacggattcttgggtccttctttctaagggtataaaggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccgtcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctcttccatctccaaacgcctgaagcttaaccaagagtgagaggatatgtcatgttcacactcaatgcaattcgtagtggttttcttgcttatgtaagaagtacatattagtctgccatctttaaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattacaggaaaaagaaaatgtaaaagtgctaacaaggctgccaagtaatggagaagtatggttagtcttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccagttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggggaggcaatcaatgcacctagggaaaaaatttaaggaggtattcacactcagggtcatgcacttgcacaatgttgagaatgagtaccactctcaccattggtatagccaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaa

SEQ ID NO: 115790 - DNA, 4516 bp, Homo sapiens
  Payload ID: 2595
  Gene Symbol: CD96
  Gene Name: CD96 molecule
  Uniprot ID: P40200
  ENST ID: ENST00000352690
  CDS Start-End: 241-1950
acacaaatttcagagaacaatttcaacattgttctgtcgaacgttatactcagtcctgaaccacattactttcctgtctacgtttcatttcctgggggcttgccaagtgataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacgttacagcagatgaatggaacagcaaccatacgatagaaatagagataaatcagactctggaaataccatgctttcaaaatagctcctcaaaaatttcatctgagttcacctatgcatggtcggtggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccgtcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctcttccatctccaaacgcctgaagcttaaccaagagtgagaggatatgtcatgttcacactcaatgcaattcgtagtggttttcttgcttatgtaagaagtacatattagtctgccatctttaaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattacaggaaaaagaaaatgtaaaagtgctaacaaggctgccaagtaatggagaagtatggttagtcttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccagttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggggaggcaatcaatgcacctagggaaaaaatttaaggaggtattcacactcagggtcatgcacttgcacaatgttgagaatgagtaccactctcaccattggtatagccaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaattatttatctttagttccttattagttctcaagaaacaaatgctagcttcatatgtatggctgttgctttgcttcatgtgtatggctatttgtatttaacaagacttaatcatcagtaatttgtatacaaa

SEQ ID NO: 115791 - DNA, 1565 bp, Homo sapiens
  Payload ID: 2595
  Gene Symbol: CD96
  Gene Name: CD96 molecule
  ENST ID: ENST00000438817
  CDS Start-End: 100-1308
gggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacgttacagcagatgaatggaacagcaaccatacgatagaaatagagataaatcagactctggaaataccatgctttcaaaatagctcctcaaaaatttcatctgagttcacctatgcatggtcggtggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagtaagaatgttttcacactgagctattgatttaaccaagcagattgataacgataaaatttcagcaaacttgcatcattcatgcctgtttcttagctatgacttttttggggctgaaattgggttttattttttaacagctttattgagatataattcacgtcacattaacttgcccatttaaaatgtatgatctaatggtttttagtatgttcacagacttgtacaaccatgactacagccaatttcagaacattttcatcatctaataaagaaactcctaaaca

SEQ ID NO: 115792 - DNA, 500 bp, Homo sapiens
  Payload ID: 2595
  Gene Symbol: CD96
  Gene Name: CD96 molecule
  ENST ID: ENST00000465428
  CDS Start-End: 1-439
ggaaataccatgctttcaaaatagctcctcaaaaatttcatctgagttcacctatgcatggtcggtggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttggtaagggcttttgttctacagactcactggcatcctcctgtctcctgccctgctcttccttgaagaggaagcaccctattatgctgcagagcagccacatgtgggtaacagtgctggagtctgtttccctggatacttgtcattcttgttgggcagggggatgagggtaggatgctaaagaatgatgattctgttaacagaataaaatcatacagaagccaataa

SEQ ID NO: 115793 - DNA, 2039 bp, Homo sapiens
  Payload ID: 2595
  Gene Symbol: CD96
  Gene Name: CD96 molecule
  ENST ID: ENST00000494798
  CDS Start-End: 57-1763
catcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacgttacagcagatgaatggaacagcaaccatacgatagaaatagagataaatcagactctggaaataccatgctttcaaaatagctcctcaaaaatttcatctgagttcacctatgcatggtcggtggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaattttcacggatacctagtgaaacatacagttcatccccgtcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtattggctgggatccaccaaaacttcaatcaattttcctttcttaaggagataattggagccctttgattttcccaaaactccagagcaaacttaccctctcaccgttgaaccatttcatatcaaagaaaactaagctgtgtttctccagactccacccaagaaagagactttcattcctccctcaaacccttgggcagtgttttttgttgctactttagtag

SEQ ID NO: 115794 - DNA, 573 bp, Homo sapiens
  Payload ID: 2595
  Gene Symbol: CD96
  Gene Name: CD96 molecule
  ENST ID: ENST00000488054
  CDS Start-End: 66-422
gcttgaaaacatcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaagttacagcagatgaatggaacagcaaccatacgatagaaatagagataaatcagactctggaaataccatgctttcaaaatagctcctcaaaaatttcatctgagttcacctatgcatggtcggtggaaaacagcagcacggattcttgggtccttctttctaag

SEQ ID NO: 115795 - DNA, 546 bp, Homo sapiens
  Payload ID: 2595
  Gene Symbol: CD96
  Gene Name: CD96 molecule
  ENST ID: ENST00000460744
  CDS Start-End: 493-546
tctccctgtggtctttccccagctccaccggcagccctccctaaggactcctgcgagacaaagacagaaatggcttccctgaggactgagagtggttacagggctcttcctgctgcttcctctactcctgtatttcacttggctctctaaatttgtttcagctccagagcccagtgcagctgaaatcctagaagacctcacaactgtgttaaattttcacagctgaccacttaaaggcagttctcttcaaataagagagtctcactctctcacccaggctggagtgcggtggcacgatctcagctcactgcaacatctgcctcccaggttcaagagattctcctgcctcacttacatagatgagtttgataacagtcaagctgaaactaaaaagacgcagcttgactgacacagagatcctgaataagagactctttggatactgaaaagtctcttaaataagaaatgctggtgtaaggtgttcagaagacaatggagaaaaaatggaaatactgtgctgtctattacatcatccagatacatttt

SEQ ID NO: 115796 - DNA, 756 bp, Homo sapiens
  Payload ID: 2596
  Gene Symbol: CD99
  Gene Name: CD99 molecule
  ENST ID: ENST00000381177
  CDS Start-End: 1-186
accagaaaaagaagctatgcttcaaagaaaatgaaagagcttccatgtgcgtgttcctcagtgtttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcaccccccc

SEQ ID NO: 115797 - DNA, 530 bp, Homo sapiens
  Payload ID: 2596
  Gene Symbol: CD99
  Gene Name: CD99 molecule
  ENST ID: ENST00000381180
  CDS Start-End: 1-231
atggcccgcggggctgcgctggcgctgctgctcttcggcctgctgggtgttctggtcgccgccccggggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaactttgagccctgaaaatgttcaaaaatactctgtggatgcgggctccgggaatttcagcgcgtgctgtgcgccaagcaacacggggcgcagaaagaaacgtgtgcttaccaaattgtccatctgcggcggtggagaattcggaaaacagaaaaagtgggcagggaagaaagagccacggtcaccctcccacgccctaaaccgggcctatttctaattattactttaatcatgtttttctgtttccctccctttgaaacggaaacggagaccctgccggatgtggtatgttataaattcttttttcatgttat

SEQ ID NO: 115798 - DNA, 918 bp, Homo sapiens
  Payload ID: 2596
  Gene Symbol: CD99
  Gene Name: CD99 molecule
  ENST ID: ENST00000381184
  CDS Start-End: 82-615
ggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatggtcagctggcaggctctttgggaccttgtattgggatccgccgtgaagctgatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaa

SEQ ID NO: 115799 - DNA, 892 bp, Homo sapiens
  Payload ID: 2596
  Gene Symbol: CD99
  Gene Name: CD99 molecule
  Uniprot ID: P14209
  ENST ID: ENST00000381187
  CDS Start-End: 86-595
acccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatg

SEQ ID NO: 115800 - DNA, 1245 bp, Homo sapiens
  Payload ID: 2596
  Gene Symbol: CD99
  Gene Name: CD99 molecule
  Uniprot ID: P14209
  ENST ID: ENST00000381192
  CDS Start-End: 183-740
gcgcgcgtggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 115801 - DNA, 604 bp, Homo sapiens
  Payload ID: 2596
  Gene Symbol: CD99
  Gene Name: CD99 molecule
  ENST ID: ENST00000449611
  CDS Start-End: 1-604
cggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagagatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatg

SEQ ID NO: 115802 - DNA, 1243 bp, Homo sapiens
  Payload ID: 2596
  Gene Symbol: CD99
  Gene Name: CD99 molecule
  Uniprot ID: P14209
  ENST ID: ENST00000611428
  CDS Start-End: 175-657
ggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgatggctgaagacctagggaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaatt

SEQ ID NO: 115803 - DNA, 1089 bp, Homo sapiens
  Payload ID: 2596
  Gene Symbol: CD99
  Gene Name: CD99 molecule
  ENST ID: ENST00000624481
  CDS Start-End: 49-603
gcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaata

SEQ ID NO: 115804 - DNA, 573 bp, Homo sapiens
  Payload ID: 2596
  Gene Symbol: CD99
  Gene Name: CD99 molecule
  Uniprot ID: P14209
  ENST ID: ENST00000623253
  CDS Start-End: 1-483
atggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgatggctgaagacctagggaacaaggggaggtggacatggagagccaccggaatgccaacgcagagccagctgttcagcgtactcttttagagaaatag

SEQ ID NO: 115805 - DNA, 1278 bp, Homo sapiens
  Payload ID: 2597
  Gene Symbol: CD99L2
  Gene Name: CD99 molecule-like 2
  Uniprot ID: Q8TCZ2
  ENST ID: ENST00000355149
  CDS Start-End: 39-611
aactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcgaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctg

SEQ ID NO: 115806 - DNA, 3604 bp, Homo sapiens
  Payload ID: 2597
  Gene Symbol: CD99L2
  Gene Name: CD99 molecule-like 2
  Uniprot ID: Q8TCZ2
  ENST ID: ENST00000370377
  CDS Start-End: 119-907
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctatcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagcag

SEQ ID NO: 115807 - DNA, 965 bp, Homo sapiens
  Payload ID: 2597
  Gene Symbol: CD99L2
  Gene Name: CD99 molecule-like 2
  ENST ID: ENST00000418547
  CDS Start-End: 1-473
aaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggtgggtttctgaatcctgaggctcctgttggccatgtgaaaggaaaatgaatctcaggaccccaaaatcactaagccaagggaaaagtcaagctagaaactgcatcaggcaaacgtgcctcccattctactcctaaataagatagctgcaaagatggaaaaagctgcacgcctccctcacaatttgcctacaaagaaatttcttatgggcctcaatatctttaccctaaaacagttctgtgaatttcaccctggcaatacaaactgatagctgatctttacagagggagagagagccgtccctctgctcccctgatacaaatgcatctctggttgcttcctctgcccaattgcttatgtaaaaatgcaggttcactgagccagacaaaattgtgtattcagtgaaaggctgatcaaggactcaaaagaatgcaaccttttgtctctttctcttatctccctatgacctggaagcaccccacctctacccctgctttgagttgtcccacctttctggaccaaaccaatgtacgtcttacacat

SEQ ID NO: 115808 - DNA, 3493 bp, Homo sapiens
  Payload ID: 2597
  Gene Symbol: CD99L2
  Gene Name: CD99 molecule-like 2
  Uniprot ID: Q8TCZ2
  ENST ID: ENST00000437787
  CDS Start-End: 229-798
gcagcctcgccccgccccccggcctaaccccagcccaggcgccctcaggcgccggctctctagcgcgcccgacctccatcttcccggggccgcgccgcgcgcgcgcgcgggctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctatcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagc

SEQ ID NO: 115809 - DNA, 988 bp, Homo sapiens
  Payload ID: 2597
  Gene Symbol: CD99L2
  Gene Name: CD99 molecule-like 2
  Uniprot ID: Q8TCZ2
  ENST ID: ENST00000466436
  CDS Start-End: 42-683
gctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgc

SEQ ID NO: 115810 - DNA, 3742 bp, Homo sapiens
  Payload ID: 2597
  Gene Symbol: CD99L2
  Gene Name: CD99 molecule-like 2
  Uniprot ID: Q8TCZ2
  ENST ID: ENST00000613030
  CDS Start-End: 229-1047
gcagcctcgccccgccccccggcctaaccccagcccaggcgccctcaggcgccggctctctagcgcgcccgacctccatcttcccggggccgcgccgcgcgcgcgcgcgggctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccagggcccactgaaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcatgcagcagcaggtcaagagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctatcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagc

SEQ ID NO: 115811 - DNA, 590 bp, Homo sapiens
  Payload ID: 2597
  Gene Symbol: CD99L2
  Gene Name: CD99 molecule-like 2
  ENST ID: ENST00000634795
  CDS Start-End: 1-533
gagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcatgcagcagcaggtcaagagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccc

SEQ ID NO: 115812 - DNA, 4935 bp, Homo sapiens
  Payload ID: 2597
  Gene Symbol: CD99L2
  Gene Name: CD99 molecule-like 2
  ENST ID: ENST00000346693
  CDS Start-End: 43-480
cgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcctgccttaggaatgtaccacaaactagatggcttaaaacaacagaactttattctgtcactgttctggatgctagaagttctatatcaaggtgttggttgggccacattctctctgaaggctctagggaagaatctttccttgactttccccacttctggtggctctaggtgttccttggtttgtggttgcatcactccaatctctgcctctgttgtcacgtggtgttcccctttctgtgtctctctcctttctcttacaaagatgcttgttagtgggtttaaggcccacctggataatccaggatgatctcatcttgagatctttcacttaattacatctgcagagatcctttttccaaataaggaaatatatatttatagatatataatatatatacacatacatatatgtgcgcatatatatatacacacatcccttattcgttttaagcactgcacggtatgccatagtatgcattcagtaaatgtctgagtgccagctgtgtatcagttactgttttaggctttggggctacagccatggacaaatcacacataaacctgtgccttgtggagccagcgttccagtagtgtggatttggccatgacctgtattgccatttccttactggcagacacgtggtttatttcctttttatgcaattacaaatagggctacagtggacattcttgtccatgtcctttgtgcctaagtgcattgtgactgctaggaccaaagatatgtgttttttatattataaaaaacgctgccaaattgttttccaaagtggatttgccattatgcactgtcactgatgttgttataatagtacctgttttcccagacccacgccaacactgaattttatcaataaaaatattttaccaatatgatggacaaaataatatctcattgcttattatgcattcccctgattgtagtcaaatggagcatcatatatttactggccatttgcatttgcctctttggtaaattgttcacattcttcccccatttttctgccagattgcttgccttttaaaaatgggtttattaagatctctttgtattatatattgagttgagaaagtcaagggctttggagtcagacttcttgggtctaaactctacctctgccacttctgaactgtcaccttgggtaagtcacctgacttgtctgcacctcagtttccttatctcttacatgaagataataagaagccctacctcctaggatcactgtaaggatgacatgggaggagccatgtgaagcactcagcacagtccttggaacaagagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggtgggtttctgaatcctgaggctcctgttggccatgtgaaaggaaaatgaatctcaggaccccaaaatcactaagccaagggaaaagtcaagctagaaactgcatcaggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctatcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagcag

SEQ ID NO: 115813 - DNA, 759 bp, Homo sapiens
  Payload ID: 2598
  Gene Symbol: CKS1B
  Gene Name: CDC28 protein kinase regulatory subunit 1B
  Uniprot ID: P61024
  ENST ID: ENST00000308987
  CDS Start-End: 48-287
cttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatcta

SEQ ID NO: 115814 - DNA, 820 bp, Homo sapiens
  Payload ID: 2598
  Gene Symbol: CKS1B
  Gene Name: CDC28 protein kinase regulatory subunit 1B
  ENST ID: ENST00000368436
  CDS Start-End: 64-267
gtgctgttgggagttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccaggtcagtgcactggctaaaaacaaccatatagaactgctacactgagagaatgaaagaataagattgtataacccaaatagggagataggaaatggtttactggttccttccccctccagtcgtgggggatttttttaaaaaaaaactagtgaccaaaaataagactaaaatatctgggaagttcagagacaacctgtcactgaaaaacctcctgtaatctttcattcaatcagagggtattctttttaaggccacatatagcctgatcatagcccctgcctcattctccatcgaaaacattcttggatgtgttctaaataagcaaaggaaagtatatttattgataagacaccagacacccagctgccaggcaaaactaataagggacaccctggggctgtataaacatagcaaaagaactgatattaacaattctgtacttggcagacagtccagacttctgggtctgcttctaaggccatatgcttaagtctttatttagttataaagatctgagtgggtgatagctggggaggtggtagtggaatacactataggttgtacatagaa

SEQ ID NO: 115815 - DNA, 912 bp, Homo sapiens
  Payload ID: 2598
  Gene Symbol: CKS1B
  Gene Name: CDC28 protein kinase regulatory subunit 1B
  ENST ID: ENST00000368439
  CDS Start-End: 250-441
tgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcggttagtgctggcgcgggagcaatagcgagggtcgtgagctttggccgctgagggcacaaggaattagtaacaggaactgaggcgatagaattggcgcatgcgtacgagacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatct

SEQ ID NO: 115816 - DNA, 613 bp, Homo sapiens
  Payload ID: 2599
  Gene Symbol: CKS2
  Gene Name: CDC28 protein kinase regulatory subunit 2
  Uniprot ID: P33552
  ENST ID: ENST00000314355
  CDS Start-End: 96-335
agtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcattta

SEQ ID NO: 115817 - DNA, 10134 bp, Homo sapiens
  Payload ID: 2600
  Gene Symbol: CDC42BPA
  Gene Name: CDC42 binding protein kinase alpha (DMPK-like)
  Uniprot ID: Q5VT25
  ENST ID: ENST00000334218
  CDS Start-End: 533-5731
atttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaacgctctccatcctgtactccagctagcaaaggcagacgtactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtta

SEQ ID NO: 115818 - DNA, 10445 bp, Homo sapiens
  Payload ID: 2600
  Gene Symbol: CDC42BPA
  Gene Name: CDC42 binding protein kinase alpha (DMPK-like)
  ENST ID: ENST00000366764
  CDS Start-End: 944-6043
gcggcccggtgcgggtgtcggggagaccgggctctctgcccggcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaaggctagcaaaggcagacgtactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtt

SEQ ID NO: 115819 - DNA, 10610 bp, Homo sapiens
  Payload ID: 2600
  Gene Symbol: CDC42BPA
  Gene Name: CDC42 binding protein kinase alpha (DMPK-like)
  ENST ID: ENST00000366766
  CDS Start-End: 3152-6208
gcggcccggtgcgggtgtcggggagaccgggctctctgcccggcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaaactgatcccgttgagaacacatatgtatggaacccgagcgtcaagtttcacatccagtcacggtccacatctccttccacatctagtgaagctgagccagttaagactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtt

SEQ ID NO: 115820 - DNA, 9320 bp, Homo sapiens
  Payload ID: 2600
  Gene Symbol: CDC42BPA
  Gene Name: CDC42 binding protein kinase alpha (DMPK-like)
  Uniprot ID: Q5VT25
  ENST ID: ENST00000366767
  CDS Start-End: 1-4917
atgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaaactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtta

SEQ ID NO: 115821 - DNA, 10855 bp, Homo sapiens
  Payload ID: 2600
  Gene Symbol: CDC42BPA
  Gene Name: CDC42 binding protein kinase alpha (DMPK-like)
  Uniprot ID: Q5VT25
  ENST ID: ENST00000366769
  CDS Start-End: 1293-6452
tccgcaagcctccgcctctgtgcggcgggactggaggagcctcgctgagcccagggcgcgagcgcgagaggagagggaaggcgggggagggctggaagggagaggaagggagtggttgggagccgggctgccgcagcctctagtctcctcagccgcggaagcgacccctcctcctgcgccgggccgcctccctcctcgctgtggaaagatgcccttagcccaggggtgtgaagaagggggagaagtagctgccagagccgcccgcgccgccgccgcagctgctgctgcttgtgtcctttgaattcagagaagcacccccccgcctggggcgtcgggagcctccggcgcggcggcccggtgcgggtgtcggggagaccgggctctctgcccggcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaaactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtta

SEQ ID NO: 115822 - DNA, 3786 bp, Homo sapiens
  Payload ID: 2600
  Gene Symbol: CDC42BPA
  Gene Name: CDC42 binding protein kinase alpha (DMPK-like)
  ENST ID: ENST00000442054
  CDS Start-End: 1-3145
agaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaaactgatcccgttgagaacacatatgtatggaacccgagcgtcaagtttcacatccagtcacggtccacatctccttccacatctagtgaagctgagccagttaagactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaa

SEQ ID NO: 115823 - DNA, 2501 bp, Homo sapiens
  Payload ID: 2600
  Gene Symbol: CDC42BPA
  Gene Name: CDC42 binding protein kinase alpha (DMPK-like)
  ENST ID: ENST00000429440
  CDS Start-End: 1-1639
cgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaagtaagtgccggggctacaggaaggtgcctctgagacagggtgacccccagctccctcccctcctgtcccgtgggtgacatgtccttcacttacgtgtgcccattgcattctcaagtggctgcagtgtctcagaccctgctgggtaatgcctaataggcacaaatgcagttgttaagaaaatagtcccagagtccttctagagtgtacaggccatctgggagacagacaaatatgattacaaattgtgatgataaaggctctgaaggaagtaaacagcatacattaatagagaataacaaggggtagctgttagggatgaatccctacttggcagaataattaggaaaatcactccctagaggtggagtcatgtttgagtaatgtttggttaactgaaagaaggctagtatggctacatggtagtggtgaggaagtaacaaaaattagagcggggtagcaggtaagggtcagaccagcagggacttgaagaccaaggtaagacattttttactttattcaaaaggaaaaggaagacttttaagtagggaagaattttctttcaatttacattcttaaaacaatcctgcgggctgccaagtggagaatggactagaggcaggaagagtggaagccagcatccagataggagactcctagagtggtcccaatggaaaccaatgagggcttgggatgcagcaggggcagaaggagagaagatggtagattctccagatatattttcagagttaaaagcagtaagacttgatgatgaattagtcatggaaaagtaagggagagagttaaagatgactcccagacttcctgctagggccttagtatgataccatttactcccatttaccaccgtttaagaaggggctgaggcaggacattccacgcatgtccaaaggtcccgaggtagcaaaaaaaaaaaaaaaa

SEQ ID NO: 115824 - DNA, 2183 bp, Homo sapiens
  Payload ID: 2600
  Gene Symbol: CDC42BPA
  Gene Name: CDC42 binding protein kinase alpha (DMPK-like)
  ENST ID: ENST00000441725
  CDS Start-End: 1-2183
ggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaagattccttttcttcttcctcatcttcactgattgattttttggatgacactgatcccgttgagaacacatatgtatggaacccgagcgtcaagtttcacatccagtcacggtccacatctccttccacatctagtgaagctgagccagttaagactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcag

SEQ ID NO: 115825 - DNA, 7355 bp, Homo sapiens
  Payload ID: 2600
  Gene Symbol: CDC42BPA
  Gene Name: CDC42 binding protein kinase alpha (DMPK-like)
  ENST ID: ENST00000448940
  CDS Start-End: 1-2953
gcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaaactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgccaggtttcccttatccatcccctcatcatcactccggtctgatctcctctccgatcaactttgaacacatctatcacatgactgttaattctgctgaaaaatttctctctcctgattccataaaccctgaatattccccgtctctgcgctctgtccctggtacaccaagctttatgactctgaggaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtt

SEQ ID NO: 115826 - DNA, 6758 bp, Homo sapiens
  Payload ID: 2601
  Gene Symbol: CDC42BPB
  Gene Name: CDC42 binding protein kinase beta (DMPK-like)
  Uniprot ID: Q9Y5S2
  ENST ID: ENST00000361246
  CDS Start-End: 290-5425
gggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggaaatattacctcctggttctcacacaggcttttctggattacatttgccattcattggttttacattcacaacggaaagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaagctaaatgaagaaatcgaacgcttgaagaataaaatagcagattcaaacaggctcgagcgacagcttgaggacacagtggcgcttcgccaagagcgtgaggactccacgcagcggctgcgggggctggagaagcagcaccgcgtggtccggcaggagaaggaggagctgcacaagcaactggttgaagcctcagagcggttgaaatcccaggccaaggaactcaaagatgcccatcagcagcgaaagctggccctgcaggagttctcggagctgaacgagcgcatggcagagctccgtgcccagaagcagaaggtgtcccggcagctgcgagacaaggaggaggagatggaggtggccacgcagaaggtggacgccatgcggcaggaaatgcggagagctgagaagctcaggaaagagctggaagctcagcttgatgatgctgttgctgaggcctccaaggagcgcaagcttcgtgagcacagcgagaacttctgcaagcaaatggaaagcgagctggaggccctcaaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggaggacatggctcggcccccgcagaggccatccgctgtgccgttgcccaccacgcaggccctggctctggctggaccgaagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctctcacaacagtcttttgatgccctttgtgctgtggagctcgaaagcgaggagtacctgctttgcttcagccacatgggactgtacgtggacccgcaaggccggagggcacgcgcgcaggagctcatgtggcctgcggctcctgtcgcctgtagttgcagccccacccacgtcacggtgtacagcgagtatggcgtggacgtctttgatgtgcgcaccatggagtgggtgcagaccatcggcctgcggaggataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgcccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagttc

SEQ ID NO: 115827 - DNA, 1999 bp, Homo sapiens
  Payload ID: 2601
  Gene Symbol: CDC42BPB
  Gene Name: CDC42 binding protein kinase beta (DMPK-like)
  ENST ID: ENST00000559043
  CDS Start-End: 1-1999
tggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcct

SEQ ID NO: 115828 - DNA, 528 bp, Homo sapiens
  Payload ID: 2601
  Gene Symbol: CDC42BPB
  Gene Name: CDC42 binding protein kinase beta (DMPK-like)
  ENST ID: ENST00000558321
  CDS Start-End: 1-390
accgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtaggtatttttgttggagattttccatttggttttgggtttggcatatagtcagaagggaagttttcaatttgaggtacaattaagaaaccaagtatattaattcagaaaatgaatccattttggagatagttgaaattttctgtttggggagttttgtttcccaaataaaaattaagttggaaagca

SEQ ID NO: 115829 - DNA, 5742 bp, Homo sapiens
  Payload ID: 2602
  Gene Symbol: CDC42BPG
  Gene Name: CDC42 binding protein kinase gamma (DMPK-like)
  Uniprot ID: Q6DT37
  ENST ID: ENST00000342711
  CDS Start-End: 1-4656
atggagcggcggctgcgcgcgctggagcagctggcgcggggcgaggccggcggctgcccggggctcgacggcctcctagatctgctgctggcgctgcaccacgagctcagcagcggccccctacggcgggagcgcagcgtggcgcagttcctgagctgggccagccccttcgtatcaaaggtgaaagaactgcgtctgcagagagatgactttgagatcttgaaggtgatcggccgaggagcctttggggaggtcaccgtggtgaggcagagggacactgggcagatttttgccatgaaaatgctgcacaagtgggagatgctgaagagggctgagacagcctgtttccgggaggagcgggatgtgctcgtgaaaggggacagccgttgggtgaccactctgcactatgccttccaagacgaggagtacctgtaccttgtgatggactactatgctggtggggacctcctgacgctgctgagccgcttcgaggaccgtctcccgcccgagctggcccagttctacctggctgagatggtgctggccatccactcgctgcaccagctgggttatgtccacagggatgtcaagccagacaacgtcctgctggatgtgaacgggcacattcgcctggctgacttcggctcctgcctgcgtctcaacaccaacggcatggtggattcatcagtggcagtagggacgccggactatatctcccctgagatcctgcaggccatggaggagggcaagggccactacggcccacagtgtgactggtggtcgcttggagtctgcgcctatgagctgctctttggggagacgcccttctatgctgagtccttggtggaaacctacggcaagatcatgaaccacgaggaccacctgcagttccccccggacgtgcctgacgtgccagccagcgcccaagacctgatccgccagctgctgtgtcgccaggaagagcggctaggccgtggtgggctggatgacttccggaaccatcctttcttcgaaggcgtggactgggagcggctggcgagcagcacggccccctatattcctgagctgcgggggcccatggacacctccaactttgatgtggatgacgacaccctcaaccatccagggaccctgccaccgccctcccacggggccttctccggccatcacctgccattcgtgggcttcacctacacctcaggcagtcacagtcctgagagcagctctgaggcttgggctgccctggagcggaagctccagtgtctggagcaggagaaggtggagctgagcaggaagcaccaagaggccctgcacgcccccacagaccatcgggagctggagcagctacggaaggaagtgcagactctgcgggacaggctgccagagatgctgagggacaaggcctcattgtcccagacggatgggcccccagctggtagcccaggtcaggacagtgacctacggcaggagcttgaccgacttcaccgggagctggccgagggtcgggcagggctgcaggctcaggagcaggagctctgcagggcccaggggcagcaggaggagctgcttcagaggctacaggaggcccaggagagagaggcggccacagctagccagacccgggccctgagctcccagctggaggaagcccgggctgcccagagggagctggaggcccaggtgtcctccctgagccggcaggtgacgcagctgcagggacagtgggagcaacgccttgaggagtcgtcccaggccaagaccatccacacagcctctgagaccaacgggatgggaccccctgagggtgggcctcaggaggcccaactgaggaaggaggtggccgccctgcgagagcagctggagcaggcccacagccacaggccgagtggtaaggaggaggctctgtgccagctgcaggaggaaaaccggaggctgagccgggagcaggagcggctagaagcagagctggcccaggagcaggagagcaagcagcggctggagggtgagcggcgggagacggagagcaactgggaggcccagctcgccgacatcctcagctgggtgaatgatgagaaggtctcaagaggctacctgcaggccctggccaccaagatggcagaggagctggagtccttgaggaacgtaggcacccagacgctccctgcccggccactggaccaccagtggaaggcgcggcgactgcagaagatggaggcctcggccaggctggagctgcagtcagcgctggaggccgagatccgcgccaagcagggcctgcaggagcggctgacacaggtgcaggaggcccagctgcaggctgagcgccgtctgcaggaggccgagaagcagagccaggccctgcaacaggagctcgccatgctgcgggaggagctgcgggcccgagggccagtggacaccaagccctcaaactccctgattcccttcctgtccttccggagctcagagaaggattctgccaaggaccctggcatctcaggagaggccacaaggcatggaggagagccagatctgaggccggagggccgacgcagcctgcgcatgggggctgtgttccccagagcacccactgccaacacagcctctacagaaggtcttcctgctaagcccggctcacacacgctgcgcccccggagcttcccatccccgaccaagtgtctccgctgcacctcgctgatgctgggcctgggccgccagggcctgggttgtgatgcctgcggctacttttgtcacacaacctgtgccccacaggccccaccctgccccgtgccccctgacctcctccgcacagccctgggagtacaccccgaaacaggcacaggcactgcctatgagggctttctgtcggtgccgcggccctcaggtgtccggcggggctggcagcgcgtgtttgctgccctgagtgactcacgcctgctgctgtttgacgcccctgacctgaggctcagcccgcccagtggggccctcctgcaggtcctagatctgagggacccccagttctcggctacccctgtcctggcctctgatgttatccatgcccaatccagggacctgccacgcatctttagggtgacaacctcccagctggcagtgccgcccaccacgtgcactgtgctgctgctggcagagagcgagggggagcgggaacgctggctgcaggtgctgggtgagctgcagcggctgctgctggacgcgcggccaagaccccggcccgtgtacacactcaaggaggcttacgacaacgggctgccgctgctgcctcacacgctctgcgctgccatcctcgaccaggatcgacttgcgcttggcaccgaggaggggctctttgtcatccatctgcgcagcaacgacatcttccaggtgggggagtgccggcgcgtgcagcagctgaccttgagccccagtgcaggcctgctggtcgtgctgtgtggccgcggccccagcgtgcgtctctttgccctggcggagctggagaacatagaggtagcaggtgccaagatccccgagtctcgaggctgccaggtgctggcagctggaagcatcctgcaggcccgcaccccggtgctctgtgtagccgtcaagcgccaggtgctctgctaccagctgggcccgggccctgggccctggcagcgccgcatccgtgagctgcaggcacctgccactgtgcagagcctggggctgctgggcgaccggctatgtgtgggcgccgccggtggctttgcactctacccgctgctcaacgaggctgcgccgttggcgctgggggccggtttggtgcctgaggagctgccaccatcccgcgggggcctgggtgaggcactgggtgccgtggagcttagcctcagcgagttcctgctactcttcaccactgctggcatctacgtggatggcgcaggccgcaagtctcgtggccacgagctgttgtggccagcagcgcccatgggctgggggtatgcggccccctacctgacagtgttcagcgagaactccatcgatgtgtttgacgtgaggagggcagaatgggtgcagaccgtgccgctcaagaaggtgcggcccctcaatccagagggctccctgttcctctacggcaccgagaaggtccgcctgacctacctcaggaaccagctggcagagaaggacgagttcgacatcccggacctcaccgacaacagccggcgccagctgttccgcaccaagagcaagcgccgcttctttttccgcgtgtcggaggagcagcagaagcagcagcgcagggagatgctgaaggacccttttgtgcgctccaagctcatctcgccgcctaccaacttcaaccacctagtacacgtgggccctgccaacgggcggcccggcgccagggacaagtccccggctcccgaagagaagggccgagttgcccgcggctccggcccacagcggccccacagcttctccgaggcgttgcggcgcccagcctccatgggcagcgaaggcctcggtggagacgcagaccccatgaagaggaaaccctggacatccctgtccagcgagtctgtgtcctgcccccagggatcgctgagccctgcaacctccctaatgcaggtctcagaacggccccgaagcctccccctatcccctgaattggagagctctccttgatgccctctgttagggcccaccccaatcccagggcagaaggacatgagggagcaaagagcttgaggaatgccatactccggctggtccgggacatggaaattcggactcagggaggacccgggctgggcaatgactgggagacttgcctgggttcccaggacttgggggtcctgactcccagccctcatcctgccttacccctctgttcccagccccagcctttctaagccattgggaatagaatggccccttttgttctggtgtccaggggtgattgtgccaaagctcttatttccagtgccaagcccccagaggcttgtaagagttgggatgagggatggagagggactgggtctctgggaacaggttggaggtcttatctgtggactgtctgactcccagctgaggccaagatggggcatgtccccgtctctgcttagcgtctgggtgagaaaaacaggctgtgatccagaagaagggaagatagagaaggagggaaaggatgtaggcgaaggaggtgagagacaggataggaggaaggaagtggaggaggaggtgataggaattggaaggaggtagaagccgtgcagaggaagaggggagagggacgaaggaggagcgatgaagaagaggagggagacaaaaagagggatggaggagagagggagtctggagaacaaagggtcctttctctggggaggggtgcagtgggcggggctgacactgtcagccaatcctcccatcggggaagagaatcctggacagggacaggatggggagggtatttataagggctttttggtgggagatgggtacccagtgggggccactggagggtctccgggcacactctggcccttcccagaaagggggtcgtttttctcgaatcttcaaccagttgtgtattggaaactagggcgcattttactattgatcacagtcattatattgttattatattactatttttattaaacctccccccactgaagtgtggggggcaaaataagtatttatctcctcaaatgccacattcccaggagggacagaccctgatgctctgtgaggcgcaagaaaccaataaag

SEQ ID NO: 115830 - DNA, 2181 bp, Homo sapiens
  Payload ID: 2603
  Gene Symbol: CDC42EP1
  Gene Name: CDC42 effector protein (Rho GTPase binding) 1
  Uniprot ID: Q00587
  ENST ID: ENST00000249014
  CDS Start-End: 421-1596
gatccagcccgcggagcccgcggccagggcggcgcagaccggcccagcgactctcccgggctgccagccgggacgcgcggccgccgccgctgcagacgacgagtccgccctcgtcccgcgcccccggggctcgcggagccaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctcccagaagcccctgcagctgagactccagcccccgctgcaaaccccccagcccctactgcaaaccccacgggtcctgctgcaaaccccccagccactactgcaaaccccccagcgcctgctgcaaacccctcagcacctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccagagatggatgcgcggcaggagcgggtggaggtgctgccccaagcccgggcctcctgggagagcctggacgaagagtggagggcgccccaggcaggcagcaggaccccagtgcccagcacagtgcaagcaaacacctttgaatttgcggatgctgaggaggatgatgaggtcaaggtgtgaggggctggggcacggtcccagggccccacctaggtgcagagccggcccctcacctaacagctggttcctaccagaccggagaggggagaagtcatgttgcccctaaacccctccccacctctgcaggacagacatgggagggaggacagggaaggccaggcttgctctgggacttttatgctcccagaggccctgccaaactgaccacctcccccgactgccactctggacctaatagctgttccttaggccccactccatgccacccccaccagctggaggacccagcctcacagtgtgtcctttgtgccagaccaagcggcccgtggggggtggggggcagggagtgtaccacacagggccattgtctcacctcccaaagggaccgcctgcccccagctcatcccagagcgtccctgctgcaaccctgacagccgtctcccaggccgcttccccaacatccccgccccagcctccctcttaccccagaaaggtcaggtatgacctcccggggaggaatcccacctgcctgtataccccagacttgcctctggggcctgattaaataaggctgttttgataaaa

SEQ ID NO: 115831 - DNA, 564 bp, Homo sapiens
  Payload ID: 2603
  Gene Symbol: CDC42EP1
  Gene Name: CDC42 effector protein (Rho GTPase binding) 1
  ENST ID: ENST00000434728
  CDS Start-End: 419-564
ttgaatatgctcacgcatggaggaggcagctggaaaaagccacttttgaccacaggatccttattccaggaagctccttgaaggtggatggttcagaggaacctctgctctggctgtttacccagcttcacaaagctttggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccat

SEQ ID NO: 115832 - DNA, 588 bp, Homo sapiens
  Payload ID: 2603
  Gene Symbol: CDC42EP1
  Gene Name: CDC42 effector protein (Rho GTPase binding) 1
  ENST ID: ENST00000415670
  CDS Start-End: 408-588
agtattgagatttctatgcttggaggtggcagcaatggttttaaaaaaggaagaaggctgagccgcagacataggtgttcttaaggatcattattgacttttatcagctgaggtcccaggtctgtgtaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggaca

SEQ ID NO: 115833 - DNA, 720 bp, Homo sapiens
  Payload ID: 2603
  Gene Symbol: CDC42EP1
  Gene Name: CDC42 effector protein (Rho GTPase binding) 1
  ENST ID: ENST00000430687
  CDS Start-End: 511-720
gcagaccggcccagcgactctcccgggctgccagccgggacgcgcggccgccgccgctgcagacgacgagtccgccctcgtcccgcgcccccggggctcgcggagccagacggaatgttgctcttgttgccgaggctggagtgccgtgatgtgatcttggctcactgcaacctctgcctccaaggttcaagtgattctcctgccacagcttcctgggtagctgggattacaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagc

SEQ ID NO: 115834 - DNA, 2023 bp, Homo sapiens
  Payload ID: 2604
  Gene Symbol: CDC42EP2
  Gene Name: CDC42 effector protein (Rho GTPase binding) 2
  Uniprot ID: O14613
  ENST ID: ENST00000279249
  CDS Start-End: 493-1125
attggctccgcgggccggggcggggctgcggggtccgcggtgcactctgtaagttcaccgccggtcgggtccggccgccgcgctgtccagctcctgagaccttgctgtccgccggtctgccgtctgcgcgcctcacgctcctcagccctggaccggggacaagtaaccctcggtgacaagaccaaagtgcactgctgcccacacagttcctacctttctggcttcaattcttcagaagagtttgccgtcctttggggagaacgtgatttttgttatctcagcccactgacttcattgatctctaatcttttttaattccttgggccaactttgttcgtgcccccacactgtagccagaagcccgttggcgagctctggcacctgcaaaccaccccgtggaacgagtgtttcctctggctgagggttggagaggaggtgtggtctcagcaggcggcccgtagcctcacagccaggcctggtggtgaggtcaccatgtccaccaaggtgcccatctatctgaagcgtggcagtcgcaagggcaagaaggagaagcttcgggacctgctgtcctcggacatgatcagcccaccgctgggggacttccgccacaccattcatattggcagtggcggcggcagtgacatgtttggcgacatctccttcctgcagggcaagttccacctcctgccggggaccatggtggaggggcctgaagaagatggcaccttcgacctccccttccagttcacccgcaccgccaccgtgtgtgggcgggagctcccggacggcccatcccctctgctcaagaacgccatctccctcccggttatcggtggaccccaggctctcaccctgcccacagcccaggctccacccaagccccctcgcctgcacctggagacccctcagccttccccacaggagggagggagtgtggacatctggaggattccagagactggctcccccaacagtggactgaccccggagtcaggggccgaggagcccttcctgtccaatgccagctccctgctgtccctgcacgtggacctggggccttccatcctggatgatgtcctgcagatcatggatcaggacctggacagcatgcagatccccacataggacacgaggctgcctaggctggggtcccaggtggggcccagccaggaggtggggtgtggacccggccctggcggcggagtcagggtcccaagatcccacctgtatggtcgctggccagtgattctccttctgagccgtgtttcccctctccctccctctccacgtgggcagggcaggccccatcgctttcctctgataaccacatggacacatcctgaagtcagcccaggcgccctgagcatcttggggcacctggaccccatcacaatactccttcttccttcaggtccctgggtgaaggctttgctgaaaccgaccccccttttcacgtcccttctgcctctgccccgttggatgccctgactgggggcaggggaagagacagggcacagctggccacagggctcagccactgagcaggctgttccgggcctttggctttgcatcctggacggggagtgtcctgtcagggaccagatgtgtcctgcctcatccctagctccaatcccttccccacgtgaccggggattctggttgcaataaaacatgctgctgctggtggcggagctccctgtccctttgccccaggtttcctcccggaggcagacagtctcccagagctgagggcttgcctctggagaccccagccccagagggctttgtggaggacaggccttgccctcaagaacgtcgtacctgacgctgagcctgtcatgagaatgcaacaggagcaaaccaagtgttgctgtgacattgattcagatgtttggcaagaggtggctgagcactggggtgggcttggcactgtgccaagcctggggccaatccctgcccagtcagctggggtctggtgggggacacccaagaataaaagaataaccacaaagtgtgcaaggga

SEQ ID NO: 115835 - DNA, 1279 bp, Homo sapiens
  Payload ID: 2604
  Gene Symbol: CDC42EP2
  Gene Name: CDC42 effector protein (Rho GTPase binding) 2
  Uniprot ID: O14613
  ENST ID: ENST00000533419
  CDS Start-End: 557-1189
cgagcgacaaattgcatgtttgtcagcatggcccccaggcctggcatggttgacacaggatgaatgcgtgacgggattccaagacctcagggtgcccatgcgtccccacccttcccccagctccttgcaagctgagctggatttccgccacgggagagtcattcctttgtttcctgttaagctccaggtgctctgggagggctcctcagccctggaccggggacaagtaaccctcggtgacaagaccaaagtgcactgctgcccacacagttcctacctttctggcttcaattcttcagaagagtttgccgtcctttggggagaacgtgatttttgttatctcagcccactgacttcattgatctctaatcttttttaattccttgggccaactttgttcgtgcccccacactgtagccagaagcccgttggcgagctctggcacctgcaaaccaccccgtggaacgagtgtttcctctggctgagggttggagaggaggtgtggtctcagcaggcggcccgtagcctcacagccaggcctggtggtgaggtcaccatgtccaccaaggtgcccatctatctgaagcgtggcagtcgcaagggcaagaaggagaagcttcgggacctgctgtcctcggacatgatcagcccaccgctgggggacttccgccacaccattcatattggcagtggcggcggcagtgacatgtttggcgacatctccttcctgcagggcaagttccacctcctgccggggaccatggtggaggggcctgaagaagatggcaccttcgacctccccttccagttcacccgcaccgccaccgtgtgtgggcgggagctcccggacggcccatcccctctgctcaagaacgccatctccctcccggttatcggtggaccccaggctctcaccctgcccacagcccaggctccacccaagccccctcgcctgcacctggagacccctcagccttccccacaggagggagggagtgtggacatctggaggattccagagactggctcccccaacagtggactgaccccggagtcaggggccgaggagcccttcctgtccaatgccagctccctgctgtccctgcacgtggacctggggccttccatcctggatgatgtcctgcagatcatggatcaggacctggacagcatgcagatccccacataggacacgaggctgcctaggctggggtcccaggtggggcccagccaggaggtggggtgtggacccggccctggcggcggagtcagggtccca

SEQ ID NO: 115836 - DNA, 5700 bp, Homo sapiens
  Payload ID: 2605
  Gene Symbol: CDC42EP3
  Gene Name: CDC42 effector protein (Rho GTPase binding) 3
  Uniprot ID: Q9UKI2
  ENST ID: ENST00000295324
  CDS Start-End: 1002-1766
ccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgacccccccccgcgcgcgcgcccggccaccggttggccccgggccagggcacaggtaccgcggctgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttttaagtcagcactgatgccaccctctcagtggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgcaaaaaaaaaaaaaaaaaaaaatctcagactgttttaagaaagtttaaaaatttgtgttggacttcatgcgggccacaggttggacaagcttgccctagggcattgtgtgctttccgtaacttctcagttgtatttcgttatccatgactctccagtgttttttctgttggaccacacccgtcacagttcacagttccaaagagaaatttcccagcctattctaaatcttgttaatgacgaagagtccaatgtatctcattatttgtagccaattttagactcttttcaatacctcccccccattttaattagtattgatcatattcagtctttcattttactcttcatctgtagcgtgacctcaaggtaaagatgaaactatttcatgaaaaggggaggagtatggctgtgcattagctctactccctctctggtaagtactggggagagaacagccctgccagtactgggtttgatagattctaaatattaatcacacatcctgcctacagttagccattttagtttctgggagttctttcatgtacattttcttccattaattgaattaggtataattgagatggcaataaatatgcccgtattagaaagaggaaacaaagctacatgcggcttatgattttgttgagtcacttctcccgaggcagcctttccaatgcctggtcccttcccctgagagcaggtggactgctggtggtggctttctttcctgcagagaggcactttagacccatacctgctgtgagctgaattgatgttctcatcctgtgaaccttctcccactttaacctaatttatctttacttgtttaaagataaggaaacccaagatgtactttatttgcaaactcaaagcaaatggcgagccacctgtgacccagtaaccagaaaagaaaccatgccatttgtataagtagagacacttcttgttgaggtaggcaaggctcttgtgagcgatttttttcccctagtgagacctaacaaaagacaagctatatcatttctgcctgaaattatctgcttgaaaagatcaaaatatcaggatacttagctcttcacaaatatgaagtcattatcacatttcactgagccagaaatcactgttaacagcacacacaaaagactacactggttgaacagcaaagagaaacccgggtctccagaatcacagtttagtccttctatattactgcaagtgacctgttttttctgaaggctccccgcaaatgaagtcctggaatggaaaaaatccataagtccataaattaacttgataaatattttagaacagacaaaagaaaatattgagtgatgtagttctaatcctcctaatatggaacctggcaagactgaatcattttactgtgaaatatataaacacaatagaatgagccaacatgatggtttctctccagtaagagtttttcttttggaaatgaggttaacctagccccaaatctagcaattctcataaaatccgattttagaattagcctcccagattaatctgaatgattgacttattttttcttaggcaagtcagtaagccacccactagacagccatatccagcaaaataagagaagtttccagatgccaaatgataagccaccatcaacccagcggggaagccttctggttggtttggctgtatgagattcaggaaggccagaatacccaaaattattcacacgacgttaacttattggtactggctaagcaatacatgtatttcctaaaggaggagatggtcttttggttgatttatggacacacttgtttcatctgactgtaaatatattgcatgctttattctgatggtgcactatttcatccagcaagcttttcatctgagaatgtttaatgttgaccttattcttagagcaagtagatctaaatatttttcagctgagttattagggagtcattattctgtggtacaatgctgcaaaaagcatcatgtggaagaatgggaactatgcttactttatgaagtgatgtataacacaatgaaatctgttttacaactactgtgctgcatttaattatcttccatttttgctgttaaaaaaaaaaaatccgttaa

SEQ ID NO: 115837 - DNA, 953 bp, Homo sapiens
  Payload ID: 2605
  Gene Symbol: CDC42EP3
  Gene Name: CDC42 effector protein (Rho GTPase binding) 3
  ENST ID: ENST00000453555
  CDS Start-End: 850-953
ccacaagcaaggctttgcctatgttttctcctggctccttctgcctcctgaccaaccctggtgcttccccgtgtggacccctgtgacatggcatgcccttcttgggagctgcagaaacgagtaatgtgagagcctgcaattgtaatcttcataaagtatatcacataccgttcaaaaacatcaagtggcatgttaaataagcttttggagaataagttgagcgtgacaccacaagaagaaaaacagaatccatgacttctcaaaacatgatcttgcttcagatgagaaagctctgtgcttagtttgctgtgagtacttctttgtgtccattgtggcctcctatctaacataaggattcctttccccaagtggtggaacagtgggtaggagagtctgttcatatcccaaaggtgtgccaaaaggatttatcaagaaggggatgacggaggttgctcttccaaaagcgtccagagtcactgagacctgacctgtgtattttgtatcctatccatgtcagcacttctccttgctgccaccgtgtgaagaaggacgtgtttgcttccccttccaccatgattgtaagtttcctgaggcctccccagccatgctgaactgtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgct

SEQ ID NO: 115838 - DNA, 997 bp, Homo sapiens
  Payload ID: 2605
  Gene Symbol: CDC42EP3
  Gene Name: CDC42 effector protein (Rho GTPase binding) 3
  ENST ID: ENST00000457889
  CDS Start-End: 351-997
cgcgcccaccggagcccgggctgagagggacctggggagctgcggcctggccggggcggcgcactcaggtggcctcgcttccctgcgggtcaccgcccgccactcgcacagctaggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaaggg

SEQ ID NO: 115839 - DNA, 542 bp, Homo sapiens
  Payload ID: 2605
  Gene Symbol: CDC42EP3
  Gene Name: CDC42 effector protein (Rho GTPase binding) 3
  ENST ID: ENST00000422687
  CDS Start-End: 501-542
gcagatcatgggggctcccttcgaattctgcctactgcatggaggatatagccttatcagtaatgtttcagaagtgttcccaagtgaaggcccagcctgtaatagagattcacaatgttttctctttgaagtgaagcagttttgttcatttcctcccatctcagaatgacttcaaatcctgacatcctcgacagcccaatactttgccacaacctgattacaactctagctctcttatttactggctatatgttattgagaaaaggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataac

SEQ ID NO: 115840 - DNA, 5124 bp, Homo sapiens
  Payload ID: 2605
  Gene Symbol: CDC42EP3
  Gene Name: CDC42 effector protein (Rho GTPase binding) 3
  Uniprot ID: Q9UKI2
  ENST ID: ENST00000611976
  CDS Start-End: 419-1183
cgctggcggtggccgggtgaccggcgggcgcaggtgccaccgcggcctgaattttactctctcgggccggcagctgcgccacttgcgcctcgtcgcgcgtctggggcagccgccaccggcttgccccagctttaggcaaatccttttgaaagaccctgagggagaagaaacgcctccctctgggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttttaagtcagcactgatgccaccctctcagtggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgcaaaaaaaaaaaaaaaaaaaaatctcagactgttttaagaaagtttaaaaatttgtgttggacttcatgcgggccacaggttggacaagcttgccctagggcattgtgtgctttccgtaacttctcagttgtatttcgttatccatgactctccagtgttttttctgttggaccacacccgtcacagttcacagttccaaagagaaatttcccagcctattctaaatcttgttaatgacgaagagtccaatgtatctcattatttgtagccaattttagactcttttcaatacctcccccccattttaattagtattgatcatattcagtctttcattttactcttcatctgtagcgtgacctcaaggtaaagatgaaactatttcatgaaaaggggaggagtatggctgtgcattagctctactccctctctggtaagtactggggagagaacagccctgccagtactgggtttgatagattctaaatattaatcacacatcctgcctacagttagccattttagtttctgggagttctttcatgtacattttcttccattaattgaattaggtataattgagatggcaataaatatgcccgtattagaaagaggaaacaaagctacatgcggcttatgattttgttgagtcacttctcccgaggcagcctttccaatgcctggtcccttcccctgagagcaggtggactgctggtggtggctttctttcctgcagagaggcactttagacccatacctgctgtgagctgaattgatgttctcatcctgtgaaccttctcccactttaacctaatttatctttacttgtttaaagataaggaaacccaagatgtactttatttgcaaactcaaagcaaatggcgagccacctgtgacccagtaaccagaaaagaaaccatgccatttgtataagtagagacacttcttgttgaggtaggcaaggctcttgtgagcgatttttttcccctagtgagacctaacaaaagacaagctatatcatttctgcctgaaattatctgcttgaaaagatcaaaatatcaggatacttagctcttcacaaatatgaagtcattatcacatttcactgagccagaaatcactgttaacagcacacacaaaagactacactggttgaacagcaaagagaaacccgggtctccagaatcacagtttagtccttctatattactgcaagtgacctgttttttctgaaggctccccgcaaatgaagtcctggaatggaaaaaatccataagtccataaattaacttgataaatattttagaacagacaaaagaaaatattgagtgatgtagttctaatcctcctaatatggaacctggcaagactgaatcattttactgtgaaatatataaacacaatagaatgagccaacatgatggtttctctccagtaagagtttttcttttggaaatgaggttaacctagccccaaatctagcaattctcataaaatccgattttagaattagcctcccagattaatctgaatgattgacttattttttcttaggcaagtcagtaagccacccactagacagccatatccagcaaaataagagaagtttccagatgccaaatgataagccaccatcaacccagcggggaagccttctggttggtttggctgtatgagattcaggaaggccagaatacccaaaattattcacacgacgttaacttattggtactggctaagcaatacatgtatttcctaaaggaggagatggtcttttggttgatttatggacacacttgtttcatctgactgtaaatatattgcatgctttattctgatggtgcactatttcatccagcaagcttttcatctgagaatgtttaatgttgaccttattcttagagcaagtagatctaaatatttttcagctgagttattagggagtcattattctgtggtacaatgctgcaaaaagcatcatgtggaagaatgggaactatgcttactttatgaagtgatgtataacacaatgaaatctgttttacaactactgtgctgcatttaattatcttccatttttgctgttaaaaaaaaaaaatccgttaatgatgtc

SEQ ID NO: 115841 - DNA, 3272 bp, Homo sapiens
  Payload ID: 2606
  Gene Symbol: CDC42EP4
  Gene Name: CDC42 effector protein (Rho GTPase binding) 4
  Uniprot ID: Q9H3Q1
  ENST ID: ENST00000335793
  CDS Start-End: 396-1466
agtttgaaccgaggaggccgagcagtcgggcagaggttcccgacggccattggctgctgcggcgccgtgacatcagcgcagaggggtgcgcggggagggttgcgcggggcgggcgcgggcggagcctggaaggggagtgtcctggaggctcccagccctgaaagcccgagagccagagggaaacaaacgccggcgctgacaggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatcttccaaacgcagtctcctgtccaggaagttccggggcagcaagcggtcacagtcggtgaccaggggggagcgggagcagcgtgacatgctgggctccctgcgggactcggccctgtttgtcaagaatgccatgtccctgccccagctcaatgagaaggaggccgcggagaagggcaccagtaagctgcccaagagcctgtcatccagccccgtgaagaaggccaatgacggggagggcggcgatgaggaggcgggcacggaggaggcagtgccccgtcggaatggggccgcgggtccacattcccctgaccccctcctcgatgagcaggcctttggggatctgacagatctgcctgtcgtgcccaaggccacgtacgggctgaagcatgcggagtccatcatgtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggcccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgaggaaacattaaaaaaaaagccctaaagca

SEQ ID NO: 115842 - DNA, 2879 bp, Homo sapiens
  Payload ID: 2606
  Gene Symbol: CDC42EP4
  Gene Name: CDC42 effector protein (Rho GTPase binding) 4
  Uniprot ID: Q9H3Q1
  ENST ID: ENST00000439510
  CDS Start-End: 214-1074
acaaacgccggcgctgacaggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggccgcggagaagggcaccagtaagctgcccaagagcctgtcatccagccccgtgaagaaggccaatgacggggagggcggcgatgaggaggcgggcacggaggaggcagtgccccgtcggaatggggccgcgggtccacattcccctgaccccctcctcgatgagcaggcctttggggatctgacagatctgcctgtcgtgcccaaggccacgtacgggctgaagcatgcggagtccatcatgtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggcccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgaggaaacattaaaaaaaaagccctaaagc

SEQ ID NO: 115843 - DNA, 1022 bp, Homo sapiens
  Payload ID: 2606
  Gene Symbol: CDC42EP4
  Gene Name: CDC42 effector protein (Rho GTPase binding) 4
  ENST ID: ENST00000580315
  CDS Start-End: 641-1022
agaaccgaattctccgcctgtacgggcagaggcgtgtacacatctcgctctcgtacacacactgcagcacacgccacccaatgtcacccggccgggaagccagagggaaggagctgtctggaagggaatggccgaaggaacaaatggtcctcctttcccctactcccgccccgcgaacccttccctcccccgccaggctcccgccccgcccgctccctcggaagcccgggaggccgaggcgcctcctggcggggtgcggggggagggcagtcgagccacccgcccccttggagccggggagacggccgctcctgggctagtgcgccccgagctcagcgcgctcagcgggatcgcaggcgggagcggtcggttaatgatttaatcgcccgcttggggcgggtgcgcgcggatcggccgtccctggccccgccccctctccggagcgcccccagccggggttacaaaactgccccctgcccccggcgcgtcccccaggagccatcctgcccgcggggatcccgtcagccgccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatcttccaaacgcagtctcctgtccaggaagttccggggcagcaagcggtcacagtcggtgaccaggggggagcgggagcagcgtgacatgctgggctccctgcgggactcggccctgtttgtcaagaatgccatgtccctgccccagctcaatgagaaggaggccg

SEQ ID NO: 115844 - DNA, 580 bp, Homo sapiens
  Payload ID: 2606
  Gene Symbol: CDC42EP4
  Gene Name: CDC42 effector protein (Rho GTPase binding) 4
  ENST ID: ENST00000579611
  CDS Start-End: 362-580
agagggaaacaaacgccggcgctgacaggggccgccagcccctccgccgcgcggagcccacgaaggggacagcgcagccggcccagagctcgggtctccggggaccgagtttcagggaaagtgtgtccgaggctactggaactctaaccagatttgcaaaatcactcctctactctgaatgcctgcggatgaagaaacaggcagggttataccatggattgctggcttatttcacagcatttaactttgccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatct

SEQ ID NO: 115845 - DNA, 737 bp, Homo sapiens
  Payload ID: 2606
  Gene Symbol: CDC42EP4
  Gene Name: CDC42 effector protein (Rho GTPase binding) 4
  ENST ID: ENST00000581014
  CDS Start-End: 218-457
ggaaacaaacgccggcgctgacaggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcaccagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctg

SEQ ID NO: 115846 - DNA, 240 bp, Homo sapiens
  Payload ID: 2606
  Gene Symbol: CDC42EP4
  Gene Name: CDC42 effector protein (Rho GTPase binding) 4
  ENST ID: ENST00000630622
  CDS Start-End: 1-240
atgccaatcctcaagcaactggtgtccagctcggtgcactccaagcgccgttcccgagcggacctcacggccgagatgatcagcgccccgctgggcgacttccgccacaccatgcaccagctccctctccagctgcacctcaggcatcctggaggagcgcagccctgccttccgggggccggacagggcccgggctgctgtctcaagacagccagacaaggagttctccttcatggatga

SEQ ID NO: 115847 - DNA, 864 bp, Homo sapiens
  Payload ID: 2607
  Gene Symbol: CDC42EP5
  Gene Name: CDC42 effector protein (Rho GTPase binding) 5
  Uniprot ID: Q6NZY7
  ENST ID: ENST00000301200
  CDS Start-End: 343-789
ctccgcccagaggggcctcagcttttccaccactgctttctagtcctttaactcctagaggcaaacttttgggggataagaaagcctgggaggggcctgtgccaaaaccctctctgcctggggactgggcggtgattccgcttctgcctgggctcctgccatggcccccgagaggggctgacactttagctcccggtgcaggtgagaacccgcccggaggaagaaggaaggcgcgggccggggattaggagacggaggcggactcggagccagggaaccaggggtccgggctagagctggagtcgtgagcgcgcgcccgccccgctctgggaggaccgcgagatgcccgtgctgaagcagctgggccccgcgcagcccaagaagcggcctgatcgcggcgccctgtccatctccgcgccgctcggcgacttccggcacacgctgcacgtggggcgcggcggcgacgccttcggggacacctcgttcctgagccgccacggcggcgggccgccccccgagccccgggcgccccccgcgggggccccgcgctccccgccgccgcccgccgtcccgcagtccgcagcgccctcgcctgccgacccgctgctgtccttccacctggatctggggccctccatgctggacgcggtgctgggcgtcatggacgcggcgcgcccggaggcggctgccgccaagcccgacgcggaaccccgccccgggacgcagcccccccaggcccgctgccgccccaacgcggacctcgagctgaacgacgtcatcggcctctaggttccctcattccccgcgcccttcccgcccggcaccccacttctgtatacataaacggccaaggtgtgtgcccgg

SEQ ID NO: 115848 - DNA, 864 bp, Homo sapiens; identical to SEQ ID NO: 115847
  Payload ID: 2607
  Gene Symbol: CDC42EP5
  Gene Name: CDC42 effector protein (Rho GTPase binding) 5
  Uniprot ID: Q6NZY7
  ENST ID: ENST00000619217
  CDS Start-End: 343-789

SEQ ID NO: 115849 - DNA, 211 bp, Homo sapiens
  Payload ID: 2607
  Gene Symbol: CDC42EP5
  Gene Name: CDC42 effector protein (Rho GTPase binding) 5
  ENST ID: ENST00000610368
  CDS Start-End: 160-211
tgacactttccttaccaggtgagaacccgcccggaggaagaaggaaggcgcgggccggggattaggagacggaggcggactcggagccagggaaccaggggtccgggctagagctggagtcgtgagcgcgcgcccgccccgctctgggaggaccgcgagatgcccgtgctgaagcagctgggccccgcgcagcccaagaagcggcctgatc

SEQ ID NO: 115850 - DNA, 861 bp, Homo sapiens
  Payload ID: 2607
  Gene Symbol: CDC42EP5
  Gene Name: CDC42 effector protein (Rho GTPase binding) 5
  Uniprot ID: Q6NZY7
  ENST ID: ENST00000617756
  CDS Start-End: 340-786
cgcccagaggggcctcagcttttccaccactgctttctagtcctttaactcctagaggcaaacttttgggggataagaaagcctgggaggggcctgtgccaaaaccctctctgcctggggactgggcggtgattccgcttctgcctgggctcctgccatggcccccgagaggggctgacactttagctcccggtgcaggtgagaacccgcccggaggaagaaggaaggcgcgggccggggattaggagacggaggcggactcggagccagggaaccaggggtccgggctagagctggagtcgtgagcgcgcgcccgccccgctctgggaggaccgcgagatgcccgtgctgaagcagctgggccccgcgcagcccaagaagcggcctgatcgcggcgccctgtccatctccgcgccgctcggcgacttccggcacacgctgcacgtggggcgcggcggcgacgccttcggggacacctcgttcctgagccgccacggcggcgggccgccccccgagccccgggcgccccccgcgggggccccgcgctccccgccgccgcccgccgtcccgcagtccgcagcgccctcgcctgccgacccgctgctgtccttccacctggatctggggccctccatgctggacgcggtgctgggcgtcatggacgcggcgcgcccggaggcggctgccgccaagcccgacgcggaaccccgccccgggacgcagcccccccaggcccgctgccgccccaacgcggacctcgagctgaacgacgtcatcggcctctaggttccctcattccccgcgcccttcccgcccggcaccccacttctgtatacataaacggccaaggtgtgtgcccgg

SEQ ID NO: 115851 - DNA, 211 bp, Homo sapiens; identical to SEQ ID NO: 115849
  Payload ID: 2607
  Gene Symbol: CDC42EP5
  Gene Name: CDC42 effector protein (Rho GTPase binding) 5
  ENST ID: ENST00000622855
  CDS Start-End: 160-211

SEQ ID NO: 115852 - DNA, 875 bp, Homo sapiens
  Payload ID: 2607
  Gene Symbol: CDC42EP5
  Gene Name: CDC42 effector protein (Rho GTPase binding) 5
  Uniprot ID: Q6NZY7
  ENST ID: ENST00000611094
  CDS Start-End: 354-800
ccgcccccacactccgcccagaggggcctcagcttttccaccactgctttctagtcctttaactcctagaggcaaacttttgggggataagaaagcctgggaggggcctgtgccaaaaccctctctgcctggggactgggcggtgattccgcttctgcctgggctcctgccatggcccccgagaggggctgacactttagctcccggtgcaggtgagaacccgcccggaggaagaaggaaggcgcgggccggggattaggagacggaggcggactcggagccagggaaccaggggtccgggctagagctggagtcgtgagcgcgcgcccgccccgctctgggaggaccgcgagatgcccgtgctgaagcagctgggccccgcgcagcccaagaagcggcctgatcgcggcgccctgtccatctccgcgccgctcggcgacttccggcacacgctgcacgtggggcgcggcggcgacgccttcggggacacctcgttcctgagccgccacggcggcgggccgccccccgagccccgggcgccccccgcgggggccccgcgctccccgccgccgcccgccgtcccgcagtccgcagcgccctcgcctgccgacccgctgctgtccttccacctggatctggggccctccatgctggacgcggtgctgggcgtcatggacgcggcgcgcccggaggcggctgccgccaagcccgacgcggaaccccgccccgggacgcagcccccccaggcccgctgccgccccaacgcggacctcgagctgaacgacgtcatcggcctctaggttccctcattccccgcgcccttcccgcccggcaccccacttctgtatacataaacggccaaggtgtgtgcccgg

SEQ ID NO: 115853 - DNA, 5413 bp, Homo sapiens
  Payload ID: 2608
  Gene Symbol: ARHGEF9
  Gene Name: Cdc42 guanine nucleotide exchange factor (GEF) 9
  Uniprot ID: O43307
  ENST ID: ENST00000253401
  CDS Start-End: 802-2352
gaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 115854 - DNA, 4644 bp, Homo sapiens
  Payload ID: 2608
  Gene Symbol: ARHGEF9
  Gene Name: Cdc42 guanine nucleotide exchange factor (GEF) 9
  ENST ID: ENST00000374870
  CDS Start-End: 778-2472
agggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaa

SEQ ID NO: 115855 - DNA, 2364 bp, Homo sapiens
  Payload ID: 2608
  Gene Symbol: ARHGEF9
  Gene Name: Cdc42 guanine nucleotide exchange factor (GEF) 9
  ENST ID: ENST00000374872
  CDS Start-End: 831-2318
gggggatggggagagaagagggatagggccagcaaggcagggatcgaacgagtgtctggcagccgggagcccagcgaagagagcgagcaagcttaggaaaacgagcgaacatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtggtagcaggccatccagtgaaatgtggagcaggcagtaggaaatatgggactggaggtgagcgagaactgatgtcatgagaaggatgattcatctgaagaactaagtggagagaacaaaaagcaaaggtccctattgacttttgaatgcggcagtcaagggtttaagtgggaagcccacttctcaattttcccaggtagtctgactgtgttgccagcaatgcttgagtgagttatcttcaggaaaaagttctcatttttttgagcagaaagcagtaaaagcatcctatcaagcacaaagaaggctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaatta

SEQ ID NO: 115856 - DNA, 2217 bp, Homo sapiens
  Payload ID: 2608
  Gene Symbol: ARHGEF9
  Gene Name: Cdc42 guanine nucleotide exchange factor (GEF) 9
  ENST ID: ENST00000374878
  CDS Start-End: 402-1865
atctaactccagcgcagcgggaggcaggcagaggtagcagctgccttctcctgggcgggcggaggctattcgcccccatcctctccctgcaccccacccccacagttctcaagccttggtgggggacaaaagcagcccattaggacccccccacactcgcacctctccctgccaagacctctaggagcagcagggcggagagacagagcctgccggttggcatggaacaaactgactgaaggcgaggtccggggcggaggggattgggttgtagggctgtggaggaggggcggcggagggggcgctggggctctcgcttgcttcagcccagcccttctagtcagcccgcgacaactcgcgccagctacggggcctcagagaagccggacttcgcaagcaccatgcagtggataaggggcggatcgggaatgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaactcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 115857 - DNA, 3758 bp, Homo sapiens
  Payload ID: 2608
  Gene Symbol: ARHGEF9
  Gene Name: Cdc42 guanine nucleotide exchange factor (GEF) 9
  ENST ID: ENST00000437457
  CDS Start-End: 380-1831
ggcaggcagaggtagcagctgccttctcctgggcgggcggaggctattcgcccccatcctctccctgcaccccacccccacagttctcaagccttggtgggggacaaaagcagcccattaggacccccccacactcgcacctctccctgccaagacctctaggagcagcagggcggagagacagagcctgccggttggcatggaacaaactgactgaaggcgaggtccggggcggaggggattgggttgtagggctgtggaggaggggcggcggagggggcgctggggctctcgcttgcttcagcccagcccttctagtcagcccgcgacaactcgcgccagctacggggcctcagagaagccggacttcgcaagcaccatgcagtggataaggggcggatcgggaatgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggggggactggagaaggcgaaatagagtttgttgggttctttgcaggaccaacccctgcataagggattctggtgtcttggaaagagctctgaactgagtagtcaaagaatgtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttg

SEQ ID NO: 115858 - DNA, 582 bp, Homo sapiens
  Payload ID: 2608
  Gene Symbol: ARHGEF9
  Gene Name: Cdc42 guanine nucleotide exchange factor (GEF) 9
  ENST ID: ENST00000623417
  CDS Start-End: 251-582
agggtagccaggcagttgctggtagcaagtaaggagaaagcaccctgctgctaactcactggctgaatttagaggtgccttatgccatgattgtaagtttcctgagccaccgtccaccaagtcattcagaactctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaa

SEQ ID NO: 115859 - DNA, 530 bp, Homo sapiens
  Payload ID: 2608
  Gene Symbol: ARHGEF9
  Gene Name: Cdc42 guanine nucleotide exchange factor (GEF) 9
  ENST ID: ENST00000466925
  CDS Start-End: 1-275
ctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaatta

SEQ ID NO: 115860 - DNA, 1888 bp, Homo sapiens
  Payload ID: 2608
  Gene Symbol: ARHGEF9
  Gene Name: Cdc42 guanine nucleotide exchange factor (GEF) 9
  ENST ID: ENST00000624210
  CDS Start-End: 213-1700
gagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagat

SEQ ID NO: 115861 - DNA, 618 bp, Homo sapiens
  Payload ID: 2608
  Gene Symbol: ARHGEF9
  Gene Name: Cdc42 guanine nucleotide exchange factor (GEF) 9
  ENST ID: ENST00000625116
  CDS Start-End: 295-618
cccttctagtcagcccgcgacaactcgcgccagctacggggcctcagagaagccggacttcgcaagcaccatgcagtggataaggggcggatcgggaatgtacccagaatgctggaaaattgcaagctaactgtcctagtctgaagaatctataatcaagaaaggaaatctgaccagctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaa

SEQ ID NO: 115862 - DNA, 898 bp, Homo sapiens
  Payload ID: 2608
  Gene Symbol: ARHGEF9
  Gene Name: Cdc42 guanine nucleotide exchange factor (GEF) 9
  ENST ID: ENST00000624538
  CDS Start-End: 773-898
ggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgagg

SEQ ID NO: 115863 - DNA, 578 bp, Homo sapiens
  Payload ID: 2608
  Gene Symbol: ARHGEF9
  Gene Name: Cdc42 guanine nucleotide exchange factor (GEF) 9
  ENST ID: ENST00000624355
  CDS Start-End: 232-578
cccttctagtcagcccgcgacaactcgcgccagctacggggcctcagagaagccggacttcgcaagcaccatgcagtggataaggggcggatcgggaatgtacccagaatgctggaaaattgcaagctaactgtcctagtctgaagaatctataatcaagaaaggaaatctgaccagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaag

SEQ ID NO: 115864 - DNA, 2143 bp, Homo sapiens
  Payload ID: 2608
  Gene Symbol: ARHGEF9
  Gene Name: Cdc42 guanine nucleotide exchange factor (GEF) 9
  Uniprot ID: O43307
  ENST ID: ENST00000623517
  CDS Start-End: 414-1805
acaataaacagcatctaactccagcgcagcgggaggcaggcagaggtagcagctgccttctcctgggcgggcggaggctattcgcccccatcctctccctgcaccccacccccacagttctcaagccttggtgggggacaaaagcagcccattaggacccccccacactcgcacctctccctgccaagacctctaggagcagcagggcggagagacagagcctgccggttggcatggaacaaactgactgaaggcgaggtccggggcggaggggattgggttgtagggctgtggaggaggggcggcggagggggcgctggggctctcgcttgcttcagcccagcccttctagtcagcccgcgacaactcgcgccagctacggggcctcagagaagccggacttcgcaagcaccatgcagtggataaggggcggatcgggaatgctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatt

SEQ ID NO: 115865 - DNA, 584 bp, Homo sapiens
  Payload ID: 2608
  Gene Symbol: ARHGEF9
  Gene Name: Cdc42 guanine nucleotide exchange factor (GEF) 9
  ENST ID: ENST00000623566
  CDS Start-End: 183-584
cggtctggggagagcgagcttgcttgggagccttgaggctctgattggcggtcgcggctagcacgccagcgcaagtcccgcccctgggcagcgaacgtgctactgcggcatctgttattggtcggcggctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatc

SEQ ID NO: 115866 - DNA, 2154 bp, Homo sapiens
  Payload ID: 2608
  Gene Symbol: ARHGEF9
  Gene Name: Cdc42 guanine nucleotide exchange factor (GEF) 9
  Uniprot ID: O43307
  ENST ID: ENST00000624843
  CDS Start-End: 867-2111
gggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaa

SEQ ID NO: 115867 - DNA, 2556 bp, Homo sapiens
  Payload ID: 2608
  Gene Symbol: ARHGEF9
  Gene Name: Cdc42 guanine nucleotide exchange factor (GEF) 9
  ENST ID: ENST00000495564
  CDS Start-End: 588-998
agcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagaaagtagggggtgatatgatcctgctttaaggagtttccaatccagccaacccaatcaaaccttttgttgacaatttgctggttccttatttttcaacaattattggtgctgaagaaagggtttcctatctcaaagagaggaagaaggaaataaaagaaaaccaccaatttgaacattctgcttctaacttacctttgatcatcaccagcatgggaagaactaattagcatttagttgacaaataactgagcagcaactatatgccagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtctt

SEQ ID NO: 115868 - DNA, 3045 bp, Homo sapiens
  Payload ID: 2609
  Gene Symbol: CDC42SE1
  Gene Name: CDC42 small effector 1
  Uniprot ID: Q9NRR8
  ENST ID: ENST00000357235
  CDS Start-End: 435-674
aatcgcgtcgccgccgcttccgccctcagccggccccacctctgccggctcgtactcggctcccccacctcgccgcagagctagcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagcggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctctgccaacctccctgctggcccaggtgagaggaggaagaggggtctggaaagaaacccagaatgcggcagaactaggagtaagtccatctcaaggtggacttctgatcattgaggatggtgagataaataggttgaaaacaatcatctgtgagtttaggagtcttaagatcctcacagcacgggagcagggagaggctctagaacaaggtttcacaaccgagatgcctttgacattttgggctgaagtgttctttgtaaggaaaacctgtttcctattttgtgcattacaggatatttagcagcaaccctggcccactctagttatgacaaccaaaaatgtctctatacattgccagatttctcctagggggcaaaatcgcctccatttgagaaccacaactctaaagtcaagatatttttctctgaagtgatttctgcttggcacgctaccctcatcatcttactcatcttaagcccgagccatggatcaactaggagcccatataaatgaggctcagtagggctgcacataatctccaaacaattctttattcagtgttttgcttgtgtttgcatgttgctatgatggacaggtccccctcctccattcttgccctctggagaagtggttcctgcagtgtagagatatgaacagggtatggtaggattggggaaaggggagagagaagcagtagatacactccttatcctccccaaattttaagctctatttctgtgccctagtcctagacacacattagactcagggagttttgtctgaagaccaggtcccactgccccctggctgaagagtctgctttaaatgggaaaacaacgtaggagcaggggtttttaggcactttcagtattctcaggtgttcttcgttctggcccttccagggtaattaggaaggcagaacaagacagatgagctcctgcctgctctgagacaagaagggtggggtctcattagctttgcaacaggaaacatcctgttttatggtagtggggtcaggaatgtaggaactggtatccattctgccaattccaccacccattcagtttgcttatccctacagaacagtgactgaggttctttttttttttttttttttttttttttcaaatttccatgtattttctgccatttttcagggtctaagattggtcatacattcccaatttactctcagttccagtcaagctggttgctctgaaagtaacccagcttgttgctctaaaatacctcagtagcctgagtgttatactagagatctaaagggttaacaggatagggtggaaaggttagagactcctagaaatctctggtcaccgtgatcttcggcctcattctaatacctgttctttggacagtctttttcctttggtgctctcttgcctttagctaccttctctaatatgtatgctaccatcactaataaagtgatgggaatgggtttgagagtcgtaatttatattaaaaagttgttggacttttaaatacattttttcaaataaaaaattaagcaaaatagttgcacagt

SEQ ID NO: 115869 - DNA, 3181 bp, Homo sapiens
  Payload ID: 2609
  Gene Symbol: CDC42SE1
  Gene Name: CDC42 small effector 1
  Uniprot ID: Q9NRR8
  ENST ID: ENST00000540998
  CDS Start-End: 571-810
aatcgcgtcgccgccgcttccgccctcagccggccccacctctgccggctcgtactcggctcccccacctcgccgcagagctagcccgggaagcccacactggcggccacggagcagagtccctcacccccaccagctgtagctgaacgtctggatggtggagaagagcagatgatctgtactggacacacgtggagatatggccatgccacgcatgtgcaaacagaggtgtacacacaggagtgcagtgatacaggacacagataaacagaatgtacacagccttcaggaaggatctcaaggtcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagcggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctctgccaacctccctgctggcccaggtgagaggaggaagaggggtctggaaagaaacccagaatgcggcagaactaggagtaagtccatctcaaggtggacttctgatcattgaggatggtgagataaataggttgaaaacaatcatctgtgagtttaggagtcttaagatcctcacagcacgggagcagggagaggctctagaacaaggtttcacaaccgagatgcctttgacattttgggctgaagtgttctttgtaaggaaaacctgtttcctattttgtgcattacaggatatttagcagcaaccctggcccactctagttatgacaaccaaaaatgtctctatacattgccagatttctcctagggggcaaaatcgcctccatttgagaaccacaactctaaagtcaagatatttttctctgaagtgatttctgcttggcacgctaccctcatcatcttactcatcttaagcccgagccatggatcaactaggagcccatataaatgaggctcagtagggctgcacataatctccaaacaattctttattcagtgttttgcttgtgtttgcatgttgctatgatggacaggtccccctcctccattcttgccctctggagaagtggttcctgcagtgtagagatatgaacagggtatggtaggattggggaaaggggagagagaagcagtagatacactccttatcctccccaaattttaagctctatttctgtgccctagtcctagacacacattagactcagggagttttgtctgaagaccaggtcccactgccccctggctgaagagtctgctttaaatgggaaaacaacgtaggagcaggggtttttaggcactttcagtattctcaggtgttcttcgttctggcccttccagggtaattaggaaggcagaacaagacagatgagctcctgcctgctctgagacaagaagggtggggtctcattagctttgcaacaggaaacatcctgttttatggtagtggggtcaggaatgtaggaactggtatccattctgccaattccaccacccattcagtttgcttatccctacagaacagtgactgaggttctttttttttttttttttttttttttttcaaatttccatgtattttctgccatttttcagggtctaagattggtcatacattcccaatttactctcagttccagtcaagctggttgctctgaaagtaacccagcttgttgctctaaaatacctcagtagcctgagtgttatactagagatctaaagggttaacaggatagggtggaaaggttagagactcctagaaatctctggtcaccgtgatcttcggcctcattctaatacctgttctttggacagtctttttcctttggtgctctcttgcctttagctaccttctctaatatgtatgctaccatcactaataaagtgatgggaatgggtttgagagtcgtaatttatattaaaaagttgttggacttttaaatacattttttcaaataaaaaattaagcaaaatagttgcacagt

SEQ ID NO: 115870 - DNA, 3498 bp, Homo sapiens
  Payload ID: 2609
  Gene Symbol: CDC42SE1
  Gene Name: CDC42 small effector 1
  Uniprot ID: Q9NRR8
  ENST ID: ENST00000439374
  CDS Start-End: 886-1125
cctggctttgtgcattgggttctggtgcctgatggacacatttttccagttacaggccgaatggtctcaatgtagctgaagaactgtgcccactgatcagtattacgtattgcaaatgcaggaggtggctgtatctgacagacccaggccttccagctccgacagatccagttctgggatgggcatcctccagaaaagaaaggaactgtactggctactcacagggtccctcatagcttcctagaaagaaaccacttgtcagtcttcatgctacagcaacttctttgtggcccatggcctttccttgcttagatactccacatactgttctccccgcaggggcggcggccttgaggggctgcagaggcaccctcccacgtcccgcgcagtgcagtgcctccgcagtccagaggggagcagtgcgccgggctccgagccggacgggtttcgtaatcgcgtcgccgccgcttccgccctcagccggccccacctctgccggctcgtactcggctcccccacctcgccgcagagctagcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagcggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctctgccaacctccctgctggcccaggtgagaggaggaagaggggtctggaaagaaacccagaatgcggcagaactaggagtaagtccatctcaaggtggacttctgatcattgaggatggtgagataaataggttgaaaacaatcatctgtgagtttaggagtcttaagatcctcacagcacgggagcagggagaggctctagaacaaggtttcacaaccgagatgcctttgacattttgggctgaagtgttctttgtaaggaaaacctgtttcctattttgtgcattacaggatatttagcagcaaccctggcccactctagttatgacaaccaaaaatgtctctatacattgccagatttctcctagggggcaaaatcgcctccatttgagaaccacaactctaaagtcaagatatttttctctgaagtgatttctgcttggcacgctaccctcatcatcttactcatcttaagcccgagccatggatcaactaggagcccatataaatgaggctcagtagggctgcacataatctccaaacaattctttattcagtgttttgcttgtgtttgcatgttgctatgatggacaggtccccctcctccattcttgccctctggagaagtggttcctgcagtgtagagatatgaacagggtatggtaggattggggaaaggggagagagaagcagtagatacactccttatcctccccaaattttaagctctatttctgtgccctagtcctagacacacattagactcagggagttttgtctgaagaccaggtcccactgccccctggctgaagagtctgctttaaatgggaaaacaacgtaggagcaggggtttttaggcactttcagtattctcaggtgttcttcgttctggcccttccagggtaattaggaaggcagaacaagacagatgagctcctgcctgctctgagacaagaagggtggggtctcattagctttgcaacaggaaacatcctgttttatggtagtggggtcaggaatgtaggaactggtatccattctgccaattccaccacccattcagtttgcttatccctacagaacagtgactgaggttctttttttttttttttttttttttttttcaaatttccatgtattttctgccatttttcagggtctaagattggtcatacattcccaatttactctcagttccagtcaagctggttgctctgaaagtaacccagcttgttgctctaaaatacctcagtagcctgagtgttatactagagatctaaagggttaacaggatagggtggaaaggttagagactcctagaaatctctggtcaccgtgatcttcggcctcattctaatacctgttctttggacagtctttttcctttggtgctctcttgcctttagctaccttctctaatatgtatgctaccatcactaataaagtgatgggaatgggtttgagagtcgtaatttatattaaaaagttgttggacttttaaatacattttttcaaataaaaaattaagcaaaatagttgcacagtaa

SEQ ID NO: 115871 - DNA, 3591 bp, Homo sapiens
  Payload ID: 2610
  Gene Symbol: CDC42SE2
  Gene Name: CDC42 small effector 2
  Uniprot ID: Q9NRR3
  ENST ID: ENST00000360515
  CDS Start-End: 547-801
gagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttttttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctggttggcctttcctttaaa

SEQ ID NO: 115872 - DNA, 3485 bp, Homo sapiens
  Payload ID: 2610
  Gene Symbol: CDC42SE2
  Gene Name: CDC42 small effector 2
  Uniprot ID: Q9NRR3
  ENST ID: ENST00000395246
  CDS Start-End: 444-698
gctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttttttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctggttggcctttccttt

SEQ ID NO: 115873 - DNA, 277 bp, Homo sapiens
  Payload ID: 2610
  Gene Symbol: CDC42SE2
  Gene Name: CDC42 small effector 2
  ENST ID: ENST00000502582
  CDS Start-End: 1-165
catgttggatcaggagacctgttcagtggaatgaattcaccctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtaagatggcagaataaagatgattacactagca

SEQ ID NO: 115874 - DNA, 2025 bp, Homo sapiens
  Payload ID: 2610
  Gene Symbol: CDC42SE2
  Gene Name: CDC42 small effector 2
  ENST ID: ENST00000503291
  CDS Start-End: 646-819
cgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctgtaagtatgaaaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaa

SEQ ID NO: 115875 - DNA, 4352 bp, Homo sapiens
  Payload ID: 2610
  Gene Symbol: CDC42SE2
  Gene Name: CDC42 small effector 2
  Uniprot ID: Q9NRR3
  ENST ID: ENST00000505065
  CDS Start-End: 522-776
gcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccagtgagtactcagagctggggtctggacctgacggccagacatggccaggccaataatagtaaatatatgtatatatatataattttttaatggtgaacttattgggaaaggcaaaattactcagctaagtgtagtttctgcacttggaatgtaagttttaggttcttttccttattaagaactttaaatactttaaaacatctggttggggaggattctgatgacaagatgcttcttatgtgtcctttaaacaagagtgaaatcattattttgagtattgaggccgagcatggtggctcacacctgtaatcccagcactttgggaggcctaggtgggctgatcacctgaggccaggaattggagactagcctggccaacatggtgaaaccccatctctactaaaaatacaaaaattagctgggcatggtggcgcatgcctgtaatcgcagctactcaggaggctgaggcacgagaattgcttgaacctgggaggcaggggttgcagtcagctgagaatgcgccactgcgctccagcctgggtgacagagcaagaccctgtctcaaaaaagtactgatactaaagataatctcttgggtagtaattttacagttaagacttcattgtttataaacttttcaaattaattaaaaagactactttgaaaaaggataaaccctgaaaatgtagaaataatttcaagtttttttttgttttatagggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttttttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaa

SEQ ID NO: 115876 - DNA, 1888 bp, Homo sapiens
  Payload ID: 2611
  Gene Symbol: CLK1
  Gene Name: CDC-like kinase 1
  Uniprot ID: P49759
  ENST ID: ENST00000321356
  CDS Start-End: 137-1591
gtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttgatatgtatctgaacagtttgttctaagtaccatttttcttcctacttctattaaagaatggacataga

SEQ ID NO: 115877 - DNA, 1192 bp, Homo sapiens
  Payload ID: 2611
  Gene Symbol: CLK1
  Gene Name: CDC-like kinase 1
  ENST ID: ENST00000409769
  CDS Start-End: 61-984
tacagtttgaagacagtaatacctggaattgagcatcatgtctgtcattcttaaatttgcatgcatctttctaacaggggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaa

SEQ ID NO: 115878 - DNA, 1664 bp, Homo sapiens
  Payload ID: 2611
  Gene Symbol: CLK1
  Gene Name: CDC-like kinase 1
  ENST ID: ENST00000409403
  CDS Start-End: 100-1167
ctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtga

SEQ ID NO: 115879 - DNA, 2026 bp, Homo sapiens
  Payload ID: 2611
  Gene Symbol: CLK1
  Gene Name: CDC-like kinase 1
  Uniprot ID: P49759
  ENST ID: ENST00000434813
  CDS Start-End: 336-1916
aagacgcaggagggagcggactaggtgacagggccgttcctgtgagcctcgcgggcgcctggcgatgcccccttttcctgcttgtttgctgcccgccgtccccggcgcgacgactgcctgctcccttcactcccaggctgcacagtggcggcgcgcccctctttcctgcgcggccgagcctgtcgccgccggatccggcctgcgggggtagttacggtgtttgctaggccggccgccctcttggagcttctgccctccgctgaggaagcggcgccgcctgacgcgggacggtcgggcgggcgccatgttgtgaaccgcctcggcggagctgtaagatggcggctgggcggaggccggcttcggccctgtggccggaaaggcgaggctccccgttgaggggggatttgctggggttccagaatgtgcgtgagccaagcagctgtggggaaacgttgtctggaatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattg

SEQ ID NO: 115880 - DNA, 1682 bp, Homo sapiens
  Payload ID: 2611
  Gene Symbol: CLK1
  Gene Name: CDC-like kinase 1
  Uniprot ID: P49759
  ENST ID: ENST00000432425
  CDS Start-End: 94-504
tttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 115881 - DNA, 1843 bp, Homo sapiens
  Payload ID: 2611
  Gene Symbol: CLK1
  Gene Name: CDC-like kinase 1
  ENST ID: ENST00000621181
  CDS Start-End: 182-1546
gtgcatgacccgccccgcggcggagacgcgctcgctgcgtcatcagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttgatatgtatctgaacagtttgttctaagtaccatttttcttcctacttctattaaagaatggacataga

SEQ ID NO: 115882 - DNA, 2120 bp, Homo sapiens
  Payload ID: 2612
  Gene Symbol: CLK2
  Gene Name: CDC-like kinase 2
  ENST ID: ENST00000355560
  CDS Start-End: 283-1776
cggcggcggcggagcggagaggccagagccggagaccgagctgggatcgggccccgggcgggggcggtgcgagcggcgccaagcagatcttaggggcggggacggagccggggcgggcgggactgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttga

SEQ ID NO: 115883 - DNA, 1934 bp, Homo sapiens
  Payload ID: 2612
  Gene Symbol: CLK2
  Gene Name: CDC-like kinase 2
  Uniprot ID: P49760
  ENST ID: ENST00000361168
  CDS Start-End: 88-1584
ccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 115884 - DNA, 2166 bp, Homo sapiens
  Payload ID: 2612
  Gene Symbol: CLK2
  Gene Name: CDC-like kinase 2
  Uniprot ID: P49760
  ENST ID: ENST00000368361
  CDS Start-End: 317-1816
ggacgtcggtccgtgcgtacgtgctcgctcacggcggcggcggcggagcggagaggccagagccggagaccgagctgggatcgggccccgggcgggggcggtgcgagcggcgccaagcagatcttaggggcggggacggagccggggcgggcgggactgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcagcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 115885 - DNA, 2120 bp, Homo sapiens; identical to SEQ ID NO: 115882
  Payload ID: 2612
  Gene Symbol: CLK2
  Gene Name: CDC-like kinase 2
  ENST ID: ENST00000576584
  CDS Start-End: 283-1776

SEQ ID NO: 115886 - DNA, 1934 bp, Homo sapiens; identical to SEQ ID NO: 115883
  Payload ID: 2612
  Gene Symbol: CLK2
  Gene Name: CDC-like kinase 2
  Uniprot ID: P49760
  ENST ID: ENST00000572269
  CDS Start-End: 88-1584

SEQ ID NO: 115887 - DNA, 2166 bp, Homo sapiens; identical to SEQ ID NO: 115884
  Payload ID: 2612
  Gene Symbol: CLK2
  Gene Name: CDC-like kinase 2
  Uniprot ID: P49760
  ENST ID: ENST00000574445
  CDS Start-End: 317-1816

SEQ ID NO: 115888 - DNA, 1846 bp, Homo sapiens
  Payload ID: 2613
  Gene Symbol: CLK3
  Gene Name: CDC-like kinase 3
  Uniprot ID: P49761
  ENST ID: ENST00000345005
  CDS Start-End: 56-1528
ggggcactggtacctccaggacctggagtgtactggaagaaatggtgcagtccagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagcagttca

SEQ ID NO: 115889 - DNA, 2621 bp, Homo sapiens
  Payload ID: 2613
  Gene Symbol: CLK3
  Gene Name: CDC-like kinase 3
  Uniprot ID: P49761
  ENST ID: ENST00000395066
  CDS Start-End: 462-2378
agttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggt

SEQ ID NO: 115890 - DNA, 1749 bp, Homo sapiens
  Payload ID: 2613
  Gene Symbol: CLK3
  Gene Name: CDC-like kinase 3
  Uniprot ID: P49761
  ENST ID: ENST00000483723
  CDS Start-End: 56-514
ggggcactggtacctccaggacctggagtgtactggaagaaatggtgcagtccagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagcagttca

SEQ ID NO: 115891 - DNA, 929 bp, Homo sapiens
  Payload ID: 2613
  Gene Symbol: CLK3
  Gene Name: CDC-like kinase 3
  ENST ID: ENST00000564468
  CDS Start-End: 1-178
cgcctttgagctcctgggcaagaacacctttgagttcctgaaggagaataacttccagccttaccccctaccacatgtccggcacatggcctaccagctctgccacgcccttagatggccctgcaaattatgtagctggtgcagggaagagggaaccacctcgaggctgttgctgtagctctgctgagagacagttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagg

SEQ ID NO: 115892 - DNA, 646 bp, Homo sapiens
  Payload ID: 2613
  Gene Symbol: CLK3
  Gene Name: CDC-like kinase 3
  ENST ID: ENST00000566926
  CDS Start-End: 1-582
gagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaaggtcagtttctggctacccccagctgaactcatgccaaggagagaccccaggcactgggcagacatacagcagagacaggccaggccgctaaaggctgcctccttgatccagctctatgggaggcggcacccaagactgctgggtgctggcaatggggcttcttgcaaactgccccagaggggcccttagccctaccccttccccatagggtggctatgaatgtaattggggaacaccagaagagccagatgtc

SEQ ID NO: 115893 - DNA, 918 bp, Homo sapiens
  Payload ID: 2613
  Gene Symbol: CLK3
  Gene Name: CDC-like kinase 3
  ENST ID: ENST00000568139
  CDS Start-End: 1-918
agcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagcaaggacccagctgaccagcgtccccatcccccttttggcagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttaga

SEQ ID NO: 115894 - DNA, 544 bp, Homo sapiens
  Payload ID: 2613
  Gene Symbol: CLK3
  Gene Name: CDC-like kinase 3
  ENST ID: ENST00000562670
  CDS Start-End: 109-544
aaacagaacaatgggcctcttcaggagcaaccgggaagccccagcagccccatggctggaggtggctggctgtgtgtttagcagggctctctgttcctcgtggcctagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgatgagattgtggggaacctgggtgaaggcacctttggcaaggtggtggagtgcttggaccatgccag

SEQ ID NO: 115895 - DNA, 860 bp, Homo sapiens
  Payload ID: 2613
  Gene Symbol: CLK3
  Gene Name: CDC-like kinase 3
  ENST ID: ENST00000563842
  CDS Start-End: 291-860
aggactgtctcgttccccactgggcatctgaattctagctgtcctttcctgacagggcctggcagttgagcctcagcaggtttccttctctgctggctccctgcagatggcctcctggggtgaggttgggggtgggaggcacagagcagggactgttaaaaccttctttggacacttaagaagggttcctggcattttgtggtcactgataaacactgtggcaggtagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggc

SEQ ID NO: 115896 - DNA, 833 bp, Homo sapiens
  Payload ID: 2613
  Gene Symbol: CLK3
  Gene Name: CDC-like kinase 3
  ENST ID: ENST00000569063
  CDS Start-End: 1-522
ggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatc

SEQ ID NO: 115897 - DNA, 572 bp, Homo sapiens
  Payload ID: 2613
  Gene Symbol: CLK3
  Gene Name: CDC-like kinase 3
  ENST ID: ENST00000562389
  CDS Start-End: 222-572
gatggtccgccccgactgcgggtttctagccctcgcgtggcgtggggacaattaggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacaatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtct

SEQ ID NO: 115898 - DNA, 10498 bp, Homo sapiens
  Payload ID: 2613
  Gene Symbol: CLK3
  Gene Name: CDC-like kinase 3
  ENST ID: ENST00000563418
  CDS Start-End: 1-211
tcttccacagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagaatataagctccacagaagaatggatttaaaaaaatctgttgccatatccctagcatcaggaagagtgcctgttcaacgaatatttgtggaatggaccaatgggtccccagctcttcatgtgagtagttggagagggagaagcataaggggatgggaagtagtatattactgttctaagactccttagaggcgaagcaccatccttacacacgtagtgcctttccacctgtcgccactgggtggcatgacgagaccatcaaactgctaaggagggaggaggccttcagcccagccctgcctaagtgctcacctttgaggctagacacttgttggccttgggtcttgctgaagagcgacagctcattggtgatagattccaacatcttgacaaaattgggcaggaaaaggatgacctggacatcatggttggctaggtgccttccacagctgataccctgagcccccttcacatgaggtccacacagtagagccactgtaggcctctggtgaacatttttgggattcaacctggaaaagaaggtgaagaagcagtatcagctacatacttgccaatcccttgcaccctataccagacaattgcctgtagcacctattggtctcagatctcttacccactgctcaccaagtcccaggctccagagggggacaaaatccactgcaggccaggtctatagggtggcactcctgttgtcccaaaccccaacctcacatcattgctgggtcctcccactaagtggttcacccagatcttgctccacacaacactgttgccacaacaccgctttgctgacccatgaacacttaatagttcctctgcagccttgtctgctcttcttccccaacgtgtctgcttcactccagcagggctggtctcatcctctcctgcacttgtaaggctctttcctgcttatgctcaaactacatcccctgcccagaaagcctttcactttccaaactctgaaccgccttttcttggagatccagttcaagacttacctctgctgggattactctggctcatgcctttacctctcctcaactcctaataagctcacagcaagtaccatagctctccattctcctcagtcagttgccaatggttctctttactgagcttagtagcttactgaagttaatgaaagcaatgctgcaggcattaacagtatctatttcataggatgctgtgcagattatcggatgcccagcacttagcagtgcctaacacaaagaaggtaaggtactcagtcagtgctgaccatggcggaggcagcaggccaagggttacctggcctcctaggctagcagctgccttggatgaagttgtcacttccagttttctgctattcaaagctgagactcctctagactcagagaagccacaaataaggagataaagaggattagccccagagctgtgcccaactcataggcagcacagttggctcacggggcagcaatgtagggaggagatggacggcaaggccataggtccctgcctagtggcagagcaatgatagtcacttaccggtttcccaaagggaggaagatgacaagatgttgtcaagctaagaggagcttcataactgcccccattcccaaacacattttggagaatttaacaatctactctatattccagacaccaaaccattcgccttcccatttctgcatttagaggaaatatgatgagaattgctcccttcagaggatgctgcagagttgtggaatctgactcactttgttctctaaaagggttcttcctctcagggagaacctctcccacccccaatcaaaagaagcagagcatggcattcacacacccagcggcaaggtgtagagtatatgggcactggaaatggacctatgtggattagaggcctggctggactgtgtaccagcagtatcatgtgggcaagtccctcagctctctgagccacagtgtgcttatccaaaaacacagggctattatttagctttgaggtgaagttatgaggaccacattaaattatgttgtgaaagcactgtggaacactgcatggcacctgacatacattaaacttcaagattactaaccacgggtctgatttctcaacatcagcaactgctacaaaggacaggagatggacctttggatagttcagacactaagagaaaagactggcacaaggacagccagccccaagaagctggctagagaggagtgtgatttggtaaggacattcagctcctgctccaaaactaatgtttctgggaagccacttaatggtctcaaagtgcccccaacagtggctctgggaggaggtgcaggagacaccagacacacgggcctgatgctctttcagagggcacctcacactaccccctcctgtaggcatttccctggctcttccctggcacaggagagcccaaggatctaacagctaggaagcaggcctaaatcaaagaaaaaggaaaaactaacactccaacccccaactcaaataggatgagggaggtggaaatcttacatctggcttggagtaagcctgcttgaattaagatcacttcagaatcaggagatgccttccatccaaacacattatcaggcccagagaatgaaaataggctggagtgaggagctacaggatttatctgcaatatcagttttctggcaagcactcccaaacaccatggctggaagcacaagccaaggaccaggttccattttgcaaatagggaaggggccctgtgggaagcaacatcctatcatgtgaggctttggatctgtgagtgctgctcagggaaaggaggctttccttgccccagtgaacccagatctgccctgctctttggaagtggcctccccactccagacaccactctcccacaaggttgcctacatcctcctctttaccgaaaaatccaacaggcacttgtcaactctaattttgattgatctctcagcactaccattgccggccgttccttttttcttcaaagactatttccttggttcttacacgctaccctcttggtttcttacctctcctgccttcttcttcatccttctaactgtgccttacatgccgacgttccccagaatcccaccctaggccctttctgttcacaccttctccttatatgatctcatctactcttacaccatctacaagctgacaactcctaaatctctagcatcagctaagacccttttctgaacttcagatcttttttttttttttttttttttttgagatggagtcttgctcttgttgcccaggctggagtgcagtggtgtgatctcagctcactgcaacctcctcctcccagattcaagcatttctcttgcctcagcctcctgagtagctgggactacaggcacctgccaccatgcctggctaatttttatatttttagtagagacagggtttcgccatgttggccaggctggttttgacctcctgacctcaagtgatctgcccgccttggcctcccgaagtatagggattacaggtgtgagtcactgcgcctggcctaagtttcagatccttatagctaagagactatttggatatctcacaggtattccaaactcaacacatccaaaacaaaacccaccatctctcccaaacctgctcttcttcccatgtttcctatcacagtgaatgtaaccaccatccaatcagatgtccaggctagaaaacttgaagttcactgatttctgacattatactttccattacctctaaaatccattcaattaccttgccctgctgaatttaccttaaaaacaacaacaacaacaacaacaacaacaacacccatctgtccacttctctttctaagagacaaaaaaaaaaaaaagagacagacaaagtctcactacgttgcccaggctggcctcgaactcctgggctcaagcagtcctcccactgcagcctctggagtaactgggattataggcatgcctcaccaaacctggtttgtccacttttctgatccctgcttccctagttgggccaccatcacttgggccctggctcagttttctaagttttgcagttttctacctgatctcactgccttcagtcttgcctccattgaattgactgtcctcattgtagctaaaaatcatctttttaaaacacaagactaactatgtcatagctctactgaaatgtcttcagcagctccctaccactcagctgtactgaggccctactttccagccacatagtgacttacggattgccaacaaccatgtgccatggtctctcgattctctctgcccttggcacatgctactccctgtacttagaataccttcttcttggccaggtgcaatggctcacacctgtaatcccagcactttgggaggcagaggcacgcagattacctgaggccaagagtttgggaccagcctggacaacatggcgaaaccctgtctctaccagaaacacaaaaaattagctgtgcatggtggcacatgcctgcagtctcagctacttcatgaggctgaggtgggagaattgctcaagctcaggaggtggaagttgcagtgagctgagattgtgccactgtgctccagcctgggtgacagagtgagaacctgtctcaaaaaaaaaaaaaaaaagaatgccttcttctttcttgcttgcccctgttaatcaccacttgttcgtcagggctcagcttggatgccactgctccagaagggtgactggtttctccagcctggggcaataatatggcttactggagaattttgtttcctctactacagcactatactttctagagacctcattgggctactagaggaaaggcacagtattttattcttcgtgtccccggtgtctagcagaaggtctggcacctggtatcagtctgtctacaaataaaataaggcactgcccttgatatatgagcataaggggcaggtgggaaggtgccaaactccagctcccctactcagttgtcagtgtggttctggaagctctcaggtatggagactgatttgcatcccagccacgtaaagtaaatgatgagtgccaaaggccaggtctccgaaggttcctagaaggaaggcttctgatagttagcaggagtctcaggcccgatggctgctatcaggagagagtcaaaaggcagcttgccagaagaataatgaggacatctaggagatgggtctgaggaggggcaaagaaacctcacagcatccaggaaagtgacttcagagagacactcccatcagatgagcagaaactgcctaatgaactcgtatgtgtgtatgggaggcactgtggtggtggccaggcagagcatccttactccacattgagtccctgccagtttatagacatttacctgttaggtcctccgaggagggtcagtgccatctgactggcacacacacctgtcatctccagtctccgctcaagggtcagcccatgcttctcagccacggacaacagctttttatgcagctcataggaaatacttgggacaaccaggccagagtctgcagttcaaaaggagaagagaaagggaaagtgactacagaaaccaagtccaaaccgggtatactctatccaagattctgcaaatgccaacattttaccatggatcacccctggcccatcctcttcatcttccgggactaaggcacgctctgcagctctgcagagctcaagtagtgactggtgaaccaagtaacaacttgttccaggtcaccacagagtggggacaaacttaagctcccttagcaatttagctttagaccacaaaggccaaatctaccaggatatatttagtgctatcgagaccagcacacagcctgtaacagcaacctatcaggcacatgagaagagaacatgattttcccaaagtgggggaaatgccatcttgggcagcggggcttcctcacaagcaggccccttgtccttcctgagaagtggaacagacactagctaaccctaatggccctctggtccctgctgttctcctcaactgtagggcaggaggacttgttccatctgcttccctcttcctcttccttctctcttctatttaccccttcctttttgattaagaaacttagctagcaaagttgttttctcaaataatttatcattttctccccatctgagttgggtgtaacccagtactcacgaaacagggaagcagtacaagttaagtaagctatggctggctttaaaaaagggtaacttttataaaagttggggagaattagtcactgaaagtacactgtggaaaatacttggtttttcaaggctcaaagccaacatctacagcagctggtgtatgtgaagaagtctatagtattattatatgcaccagtgtcaacataccaggaaagaaacagcaaacccaaaaatttggatctgcaatggacagctcttaccttgacaaccaaggtattgctccctccaagaagccaatgccatcttacaaatgccaaagccactgggctaaccagcagaccctttcccaaagagccccacttggcttcaccggccagtggaccaaccaacgcagattccaatcagcaagccactgtgggactgcacgtcactcactttgtccagctagatcaggtacctttttagatcctgtgtcctcaattatactggactgtcaactgcctgaggtaaggaaattaatcttttacttcttcagccttcgccttctcaacttgttccagctacacttatcaacggagttgagttcttatcaggtcctcagacatataaatgatgcaaacctagtgccatttctggtctggcctaactctaaggtagaagagttagggaataaaagttaataaaagttttcagtacatttatctccttccattgttccagagccttgtctagaaaaatctgttttcttcactggtcctgtcgggagaaatctcttgaggttatctatcaggtccagtcctacctgcatattcctaaagccacagagaatgaggctatagcttcatgttttaacaacaggaaaccaagcacaaagactgaaactataggacccaggtctgtatcctctcagggaaggcagaataacaatgtcatgtaatgatgatgataaaaaaggtctaacgtatcaaataaacactaacactatcctgttggctaactgagcccctctacctgcccaagtcctattcctgggctggggagaggcaacaaacagtgccattaggagcactgagtctctcctcccacctctttctgaaatgtcagtcattggtatctcaggtgccagtgctggaggctgcagactgaccttgcatgtcaacagctgattaaaacagccatttttatggcctgcttcagacacgcacatattatcagaactaattaggctgaacaattttcaaaagtcctaagccacgaacaactcaaacctgtcagacaagtcatgcacctgactacttcaaacaccctctttacctgcagagtcacgcaaggcagagctttcactcgtctatgcatttcttcacctatttatcaggactctttctgttagatttgaaatgggtcagggcagtgagtcttgggcctgctactccacaaatcaagcattctttctaggtctggctcttgtgctacgtgtacaggcaggcagcccctcccctgccccctcattctgagggctctctgggagcaggcagaagcattttctgctagctgtgccctcacagtccttaagagtacaaaacttaatggtacaggagaggagacatcaccccccaccggctggctagatgctgctgctggaagctgtgagtctcttaccacctcctcactgatctttgttgggggaaggggcactgttggtgaatcagcatatttttgcagcctagagaaagacaaagccaagagcctttctgctcagagtctggcagttatggggtctagaactctactctgactgttcctctgaaaggaacgtacaaacaccacaaaatgttccttttaaacatttatacacgtaagtccaacaagttggactggcttatcagaaacagaccaagggaataaaataaattccaaaggaaaggaaccaagaacatagcgtgtaaattgcaaacaacaacactgccactgccaaagcctgaacatgggccaagtctaattatgtttgagttggaaggtagatctttattgttcgggaatcaaggcagtaaaatcagttggtagggtttctttgagcattaatatgtattttacagctgctggtgaaacaagaaagggagagataattataaccagatcgtgacaagcagagaacttcttaggatctgattgaccttagggtatcaaggaagacaacaagtacactcagtacaggccaggaaagaaaactcctccttgcacacctgatttccactgcatgaggctgaggctgtctcttcggaccatgggacgcagtggtccagcagtgcccgtgccggctgcagtctgccccttgtcaggtcatcactttggcactgctcattccagcacacagcatttcaggcctttccctcccttatggacacatatatgcgtccccactccccctgacacagacacccttcagtagtaccatgtccaaggttcctctctccttcagacctgcccagtctttctgttgtgtaacaaagatcccacaacaaagtgttatctcagatctaactcaatcctctcactgattggccctttaattggaaaggctgcatgtgtcccaagtcttatcaataaggagcacagctcatttacaggcatgggatttctccaggactatgacttctgattctcttctgtggcagtcaacaaaactgagtgctgatgtcacactggttcctttagggatataaatccactggtaaatttataccccctgaccagcaatgtacagagtccctggagatctacactaaagctaccacaaactggtagtaatgcaatttagtgtcaagtgttctctgaaggaaggatttgttataagaaacctaactacacattcacgatactctttattatgacccacaagacctgctgtgatctggcctgtctacctcactacctttacctggtacccaacatgtaccccagaccccttggccaccttctggttcctaaattctccaagttccttctggcctcaagagacagttcgcttcacatgctttctccatcccaacactttattctctcttctggggctctattctctcttccaatgctacccctacacagcgggctcctcatctgtcaggtgtcagcacgctgcttacttcccttcattgcattcaatacatctgactccactcttaagtggtagttgaacaatgagaacacatggacacagggaggggaacatcacacaccggggcctgtcagggtgtgggggagggatagcattaggagaaatacctaatgtagatgacgggttgttgggtgcagcaaaccaccatggcacgtgtgtatacctatgtaacaaacctgcacattctgcacatgtatctcagaacttaaagtgtacatatatatatatatatatataaataaatctgactccccacctcttcccttccccacttacaactagaccagccccatgtccacagtggacctcattccttcatactaaagctccactggaacaagctttgaactttaagaggcaaagaactgctcaacaaaaacctactaattatgaagggaaaaattatctttacgaggaagaaatctggtggtcaacaccttaccaagtggtcaaacagccccagtgatgggacaaggggatacaatgtactccctgatgtgacgtactccctgatgtgacgtactccctgatgtgacgccttgagaaagacacagccctaccaaaatcctagaaaacatgtttaacatgaatcagatcaaaaggaaacaaacaatacatcaaaactaagacattctgcaaatcaattggcctagattcttcactaatatcagtatcacaaaggacaacaaaagttgtaggaactgttctagtttaaaggaaacagaagagatatgacagctgaatgtaatgtgcaatggatgattaaaaatacagctataaaggatattactgggataattgggaagttttgcatacggagtatattagatagtatttttgtaataatttaaattttgctgagagcaatcttgtagtgtggttgtgtagagcaatatatatcacactgaatttatgtgctgtggaagtatttagggatgaaatctaatgatgagtacaactaaatctcaaatggttca

SEQ ID NO: 115899 - DNA, 526 bp, Homo sapiens
  Payload ID: 2613
  Gene Symbol: CLK3
  Gene Name: CDC-like kinase 3
  ENST ID: ENST00000563297
  CDS Start-End: 470-526
aagaggcgctcggagcggggagtggggcctagctgcagccggagcctgggagacgccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggc

SEQ ID NO: 115900 - DNA, 732 bp, Homo sapiens
  Payload ID: 2613
  Gene Symbol: CLK3
  Gene Name: CDC-like kinase 3
  ENST ID: ENST00000566126
  CDS Start-End: 59-732
ggagacggtaagtgtgggctggggtccgcggcggcgacagcggcggcggcggccggggatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactg

SEQ ID NO: 115901 - DNA, 481 bp, Homo sapiens
  Payload ID: 2613
  Gene Symbol: CLK3
  Gene Name: CDC-like kinase 3
  ENST ID: ENST00000568488
  CDS Start-End: 1-481
ggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagggaagtctcaggttgccctgaagatcatccgcaacgtgggcaagtaccgggaggctgcccggctag

SEQ ID NO: 115902 - DNA, 805 bp, Homo sapiens
  Payload ID: 2613
  Gene Symbol: CLK3
  Gene Name: CDC-like kinase 3
  ENST ID: ENST00000564096
  CDS Start-End: 89-805
tcaggagcaaccgggaagccccagcagccccatggctggaggtggctggctgtgtgtttagcagggctctctgttcctcgtggcctagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctg

SEQ ID NO: 115903 - DNA, 2568 bp, Homo sapiens
  Payload ID: 2614
  Gene Symbol: CLK4
  Gene Name: CDC-like kinase 4
  Uniprot ID: Q9HAZ1
  ENST ID: ENST00000316308
  CDS Start-End: 170-1615
ctgtcacgcaggcgcgttcgcgcggcgtaggtggtgctagaggcgactcgggggattctagggcgacggcgctgccgccattttgtggggtgtttgtcgcagcggccgaggagggaagacggcagtttggcgacatttctcggccgaagggccatttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgaagagccaccgaaggaaaagatccaggagtatagaggatgatgaggagggtcacctgatctgtcaaagtggagacgttctaagagcaagatatgaaatcgtggacactttgggtgaaggagcctttggcaaagttgtagagtgcattgatcatggcatggatggcatgcatgtagcagtgaaaatcgtaaaaaatgtaggccgttaccgtgaagcagctcgttcagaaatccaagtattagagcacttaaatagtactgatcccaatagtgtcttccgatgtgtccagatgctagaatggtttgatcatcatggtcatgtttgtattgtgtttgaactactgggacttagtacttacgatttcattaaagaaaacagctttctgccatttcaaattgaccacatcaggcagatggcgtatcagatctgccagtcaataaattttttacatcataataaattaacccatacagatctgaagcctgaaaatattttgtttgtgaagtctgactatgtagtcaaatataattctaaaatgaaacgtgatgaacgcacactgaaaaacacagatatcaaagttgttgactttggaagtgcaacgtatgatgatgaacatcacagtactttggtgtctacccggcactacagagctcccgaggtcattttggctttaggttggtctcagccttgtgatgtttggagcataggttgcattcttattgaatattaccttggtttcacagtctttcagactcatgatagtaaagagcacctggcaatgatggaacgaatattaggacccataccacaacacatgattcagaaaacaagaaaacgcaagtattttcaccataaccagctagattgggatgaacacagttctgctggtagatatgttaggagacgctgcaaaccgttgaaggaatttatgctttgtcatgatgaagaacatgagaaactgtttgacctggttcgaagaatgttagaatatgatccaactcaaagaattaccttggatgaagcattgcagcatcctttctttgacttattaaaaaagaaatgaaatgggaatcagtggtcttactatatacttctctagaagagattacttaagactgtgtcagtcaactaaacattctaatatttttgtaaacattaaattattttgtacagttaagtgtaaatattgtatgttttgtatcaatagcataattaacttgttaagcaagtatggtcttgataatgcattagaaaaattaaaattaatttttctttttgaaattaccatttttaaatacctttgaaatatcctttgtgtccagtgataaatgtgattgatcttgccttttgtacatggaggtcacctctgaagtgattttttttgagtaaaaggaaatcttgactactttatattcttaaaggaatattctttatatacttcaaatttagaacttaactttaaaagtttttcttctgtaattgttgaacgggtgattattattaactctagataagcaggtactagaaaccaaaactcagaaaatgtttactgttagaattctattaaattttaagtgttgtattctttttcattgggtgatgtcagggtgataaccagacattcatggaaaggcatgcagtttgtccattgtgacagtttgtttaataaaaccacatacacactttatttaagattaaaatctaactggaaagtcagcttggaaaatggacatttccaagtatgtttggtgagtcacagatataaaaatagaaattctgatgagaggtttcagtttttaataccaagtccttaggagtcttaacattggccagcatctgtttatcaaatgacataaatacgtaaacctataagaattaagtttattaattaggcaatttatgtctgtgataattcttacgggagaaagaggatttgattggaaagcagtttgggaagaaagtgctgctgaaatttccagaatttaattgattggttacataaactttttgacttca

SEQ ID NO: 115904 - DNA, 2780 bp, Homo sapiens
  Payload ID: 2614
  Gene Symbol: CLK4
  Gene Name: CDC-like kinase 4
  ENST ID: ENST00000521621
  CDS Start-End: 85-246
tggggtgtttgtcgcagcggccgaggagggaagacggcagtttggcgacatttctcggccgaagggccatttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgatgttccattgggactgtttaccagattgctttctaaattagccagctggggttactttaaaaaacagacctgtgtggatataaaaacgaatgcccttaccctcatccgtcttggctatttgaaaggctatagtgaaatattcactgggcattcagtggatattttaaaaaattaaatcagtctgttcatcctgtctaccctgtccatagcctgtgtaattctgtagactttgtttatataatctctcagccttggtcattggccattatctattgaagagactctcatccttttagtttgtcctcatggtgttcactccatgttttgttactctatacgttgtttatggcttagcagctctaattccatgcagtattccagctaaagattgttagtgctagttttttctaatagaaggattttggacttttatgggaaggatgcccttaagagtatggtcacgtctagcttattgtattggtgatctctccctgacagttccaagccaactgatcagatatctgacctagactacccacagtcttacccaaatatcctgagttgtttctccaataaatacaacttaaagctgatgctagggaaagagaaccgggtttctgtatctccccagcctggatttgatgctagccctattgggtagtagttgtaaagatgcttctatttctgcctaaaccagccccctgggaaaaagaatgacagcatattctggggaaaggaaaggggttggtgagggcaatctagtcaacatccgtcactccattgcttgttaggcttattttagccgatgtgtctgactgggcaggtgtcccctctctccctcagtgctccatgtgcatccctcttgaagcttcgcactctgttgaagaggacactcatcccagtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgaagagccaccgaaggaaaagatccaggagtatagaggatgatgaggagggtcacctgatctgtcaaagtggagacgttctaagagcaagatatgaaatcgtggacactttgggtgaaggagcctttggcaaagttgtagagtgcattgatcatggcatggatggcatgcatgtagcagtgaaaatcgtaaaaaatgtaggccgttaccgtgaagcagctcgttcagaaatccaagtattagagcacttaaatagtactgatcccaatagtgtcttccgatgtgtccagatgctagaatggtttgatcatcatggtcatgtttgtattgtgtttgaactactgggacttagtacttacgatttcattaaagaaaacagctttctgccatttcaaattgaccacatcaggcagatggcgtatcagatctgccagtcaataaattttttacatcataataaattaacccatacagatctgaagcctgaaaatattttgtttgtgaagtctgactatgtagtcaaatataattctaaaatgaaacgtgatgaacgcacactgaaaaacacagatatcaaagttgttgactttggaagtgcaacgtatgatgatgaacatcacagtactttggtgtctacccggcactacagagctcccgaggtcattttggctttaggttggtctcagccttgtgatgtttggagcataggttgcattcttattgaatattaccttggtttcacagtctttcagactcatgatagtaaagagcacctggcaatgatggaacgaatattaggacccataccacaacacatgattcagaaaacaagaaaacgcaagtattttcaccataaccagctagattgggatgaacacagttctgctggtagatatgttaggagacgctgcaaaccgttgaaggaatttatgctttgtcatgatgaagaacatgagaaactgtttgacctggttcgaagaatgttagaatatgatccaactcaaagaattaccttggatgaagcattgcagcatcctttctttgacttattaaaaaagaaatgaaatgggaatcagtggtcttactatatacttctctagaagagattacttaagactgtgtcagtcaactaaacattctaatatttttgtaaacattaaattattttgtacagttaagtgtaaatattgtatgttttgtatcaatagcataattaacttgttaagcaagtatggtcttgataatgcattagaaaaattaaaattaatttttctttttgaaattaccatttttaaatacctttgaaatatcctttgtgtccagtgataaatgtgattgatcttgccttttgtacatggaggtcacctctgaagtgattttttttgagtaaaaggaaatcttgactacttta

SEQ ID NO: 115905 - DNA, 1955 bp, Homo sapiens
  Payload ID: 2614
  Gene Symbol: CLK4
  Gene Name: CDC-like kinase 4
  ENST ID: ENST00000522136
  CDS Start-End: 111-542
agggcgacggcgctgccgccattttgtggggtgtttgtcgcagcggccgaggagggaagacggcagtttggcgacatttctcggccgaagggccatttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgatgaaatcgtggacactttgggtgaaggagcctttggcaaagttgtagagtgcattgatcatggcatggatggcatgcatgtagcagtgaaaatcgtaaaaaatgtaggccgttaccgtgaagcagctcgttcagaaatccaagtattagagcacttaaatagtactgatcccaatagtgtcttccgatgtgtccagatgctagaatggtttgatcatcatggtcatgtttgtattgtgtttgaactactgggacttagtacttacgatttcattaaagaaaacagctttctgccatttcaaattgaccacatcaggcagatggcgtatcagatctgccagtcaataaattttttacatcataataaattaacccatacagatctgaagcctgaaaatattttgtttgtgaagtctgactatgtagtcaaatataattctaaaatgaaacgtgatgaacgcacactgaaaaacacagatatcaaagttgttgactttggaagtgcaacgtatgatgatgaacatcacagtactttggtgtctacccggcactacagagctcccgaggtcattttggctttaggttggtctcagccttgtgatgtttggagcataggttgcattcttattgaatattaccttggtttcacagtctttcagaagtttgccaacctctgctctagaagcataccattccagctactcatgatagtaaagagcacctggcaatgatggaacgaatattaggacccataccacaacacatgattcagaaaacaagaaaacgcaagtattttcaccataaccagctagattgggatgaacacagttctgctggtagatatgttaggagacgctgcaaaccgttgaaggaatttatgctttgtcatgatgaagaacatgagaaactgtttgacctggttcgaagaatgttagaatatgatccaactcaaagaattaccttggatgaagcattgcagcatcctttctttgacttattaaaaaagaaatgaaatgggaatcagtggtcttactatatacttctctagaagagattacttaagactgtgtcagtcaactaaacattctaatatttttgtaaacattaaattattttgtacagttaagtgtaaatattgtatgttttgtatcaatagcataattaacttgttaagcaagtatggtcttgataatgcattagaaaaattaaaattaatttttctttttgaaattaccatttttaaatacctttgaaatatcctttgtgtccagtgataaatgtgattgatcttgccttttgtacatggaggtcacctctgaagtgattttttttgagtaaaaggaaatcttgactactttatattcttaaaggaatattctttatatacttcaaatttagaacttaactttaaaagtttttcttctgtaattgttgaacgggtgattattattaactctagat

SEQ ID NO: 115906 - DNA, 1249 bp, Homo sapiens
  Payload ID: 2614
  Gene Symbol: CLK4
  Gene Name: CDC-like kinase 4
  ENST ID: ENST00000522556
  CDS Start-End: 168-437
gtcacgcaggcgcgttcgcgcggcgtaggtggtgctagaggcgactcgggggattctagggcgacggcgctgccgccattttgtggggtgtttgtcgcagcggccgaggagggaagacggcagtttggcgacatttctcggccgaagggccatttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattggacctgtgtggatataaaaacgaatgcccttaccctcatccgtcttggctatttgaaaggctatagtgaaatattcactgggcattcagtggatattttaaaaaattaaatcagtctgttcatcctgtctaccctgtccatagcctgtgtaattctgtagactttgtttatataatctctcagccttggtcattggccattatctattgaagagactctcatccttttagtttgtcctcatggtgttcactccatgttttgttactctatacgttgtttatggcttagcagctctaattccatgcagtattccagctaaagattgttagtgctagttttttctaatagaaggattttggacttttatgggaaggatgcccttaagagtatggtcacgtctagcttattgtattggtgatctctccctgacagttccaagccaactgatcagatatctgacctagactacccacagtcttacccaaatatcctgagttgtttctccaataaatacaacttaaagctgatgctagggaaagagaaccgggtttctgtatctccccagcctggatttgatgctagccctattgggtagtagttgtaaagatgcttctatttctgcctaaaccagccccctgggaaaaagaatgacagcatattctggggaaaggaaaggggttggtgagggcaatctagtcaacatccgtcactccattgcttgttaggcttattttagccgatgtgtctgactgggcaggtgtcccctctctccctcagtgctccatgtgcatccctcttgaagcttcgcactctgttgaagaggacactcatcccagtcattatttagaagcaaggtccttgaatgagcgagattatcgggaccggagatacgttgacgaatacaggaatgactactgtgaa

SEQ ID NO: 115907 - DNA, 1690 bp, Homo sapiens
  Payload ID: 2614
  Gene Symbol: CLK4
  Gene Name: CDC-like kinase 4
  ENST ID: ENST00000520957
  CDS Start-End: 86-250
gtggggtgtttgtcgcagcggccgaggagggaagacggcagtttggcgacatttctcggccgaagggccatttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattggtaaattaactcttgaactactagcattttagctctaatagttttaaatgatttgtcatttgcttatatagctttcatctgtcaaattgttttataattcagtcaacaaatattcgtttagaaaatatttgagtacttattttagataggcgctgaggctacagctgtaaataaaacaaagttcttatccttatgtatgtctgtctgcctgggagtggtaggagacagttgatcagtaagtgaatgtgaaatgtattaaataacatggtgagtcccaactgccagtaacgtgattagggagatgacacacaaaaagttaagtaatagtgatagaatgcccaatgagtacctttaacttgtatgtaggagggagatgggtatgttgtagtgctcattgtttcagaaataaggtagggttttataggggaggagttattccaacagagaaaagcagcatgtattattagtcacttataccatgtcgtacaggttatatttgtagatgaggccaagggatatgtttgggatttttagaagctggctttatttaagaactattcttttgcataggtagtagctagtaatttgggaaatggcctcaataaaaacttgcaacagcatgtgtgctgttttattgtattcttaccagtgtacaatttggaggtaatatatttatatagaattaaaggaatcttaaagttctaaatgattaaagaaaggctaggtaagttttcactctttcattaatttccctttttcgtttgttttgttggttctgttttctcgttttgtgcagatgttccattgggactgtttaccagattgctttctaaattagccagctggggttactttaaaaaacagtatgtaatttctttccttctccacgttaacagacttgttctgccaaacagcttatttgtagtcagtgcagacaaatcatgcttcatacgcattgttatataaggggaagggggaaggtttatgacaggatttcagagaccagagataattaataattaatgtacagtacactaaaaaaaaccatctgtaccccactattaataaatacaaaaaaccctaaggcttaacgtcatagtactggttattcataggataattatacgttgtatatatagaaaggaagtgatatgagtgatgaacagttcatttgtgctcatagttaactacgtaaacatgatactgagtccagttaaccaccaggccagtgcctgctttgatatttgtaccagatgtgtttggtggtcagcgtttaccatgatccagaatattctaatttttgaaggtcaaaaactttgagtgtttttataaaataacaaaaaactgaaaaatgcagaaaagtataaagatggtaatctctgtaggaaattagtccccattatttagctgtaaaattataattaaaaaaaaaatctttgtttct

SEQ ID NO: 115908 - DNA, 1206 bp, Homo sapiens
  Payload ID: 2614
  Gene Symbol: CLK4
  Gene Name: CDC-like kinase 4
  ENST ID: ENST00000611575
  CDS Start-End: 57-1178
ggaagacggcagtttggcgacatttctcggccgaagggccatttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgaagagccaccgaaggaaaagatccaggagtatagaggatgatgaggagggtcacctgatctgtcaaagtggagacgttctaagagcaagatatgaaatcgtggacactttgggtgaaggagcctttggcaaagttgtagagtgcattgatcatggcatggatggcatgcatgtagcagtgaaaatcgtaaaaaatgtaggccgttaccgtgaagcagctcgttcagaaatccaagtattagagcacttaaatagtactgatcccaatagtgtcttccgatgtgtccagatgctagaatggtttgatcatcatggtcatgtttgtattgtgtttgaactactgggacttagtacttacgatttcattaaagaaaacagctttctgccatttcaaattgaccacatcaggcagatggcgtatcagatctgccagtcaataaattttttacatcataataaattaacccatacagatctgaagcctgaaaatattttgtttgtgaagtctgactatgtagtcaaatataattctaaaatgaaacgtgatgaacacagttctgctggtagatatgttaggagacgctgcaaaccgttgaaggaatttatgctttgtcatgatgaagaacatgagaaactgtttgacctggttcgaagaatgttagaatatgatccaactcaaagaattaccttggatgaagcattgcagcatcctttctttgacttattaaaaaagaaatgaaatgggaatcagtggtcttactatatac

SEQ ID NO: 115909 - DNA, 2182 bp, Homo sapiens
  Payload ID: 2614
  Gene Symbol: CLK4
  Gene Name: CDC-like kinase 4
  ENST ID: ENST00000611733
  CDS Start-End: 109-1230
ggcgacggcgctgccgccattttgtggggtgtttgtcgcagcggccgaggagggaagacggcagtttggcgacatttctcggccgaagggccatttgcttttgcggagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcgaagagccaccgaaggaaaagatccaggagtatagaggatgatgaggagggtcacctgatctgtcaaagtggagacgttctaagagcaagatatgaaatcgtggacactttgggtgaaggagcctttggcaaagttgtagagtgcattgatcatggcatggatggcatgcatgtagcagtgaaaatcgtaaaaaatgtaggccgttaccgtgaagcagctcgttcagaaatccaagtattagagcacttaaatagtactgatcccaatagtgtcttccgatgtgtccagatgctagaatggtttgatcatcatggtcatgtttgtattgtgtttgaactactgggacttagtacttacgatttcattaaagaaaacagctttctgccatttcaaattgaccacatcaggcagatggcgtatcagatctgccagtcaataaattttttacatcataataaattaacccatacagatctgaagcctgaaaatattttgtttgtgaagtctgactatgtagtcaaatataattctaaaatgaaaacggatgaacacagttctgctggtagatatgttaggagacgctgcaaaccgttgaaggaatttatgctttgtcatgatgaagaacatgagaaactgtttgacctggttcgaagaatgttagaatatgatccaactcaaagaattaccttggatgaagcattgcagcatcctttctttgacttattaaaaaagaaatgaaatgggaatcagtggtcttactatatacttctctagaagagattacttaagactgtgtcagtcaactaaacattctaatatttttgtaaacattaaattattttgtacagttaagtgtaaatattgtatgttttgtatcaatagcataattaacttgttaagcaagtatggtcttgataatgcattagaaaaattaaaattaatttttctttttgaaattaccatttttaaatacctttgaaatatcctttgtgtccagtgataaatgtgattgatcttgccttttgtacatggaggtcacctctgaagtgattttttttgagtaaaaggaaatcttgactactttatattcttaaaggaatattctttatatacttcaaatttagaacttaactttaaaagtttttcttctgtaattgttgaacgggtgattattattaactctagataagcaggtactagaaaccaaaactcagaaaatgtttactgttagaattctattaaattttaagtgttgtattctttttcattgggtgatgtcagggtgataaccagacattcatggaaaggcatgcagtttgtccattgtgacagtttgtttaataaaaccacatacacactttatttaagattaaaatctaactggaaagtcagcttggaaaatggacatttccaagtatgtttggtgagtcacagatataaaaatagaaattctgatgagaggtttcagtttttaataccaagtccttaggagtcttaacattggccagcatctgtttatcaaatgacataaatacgtaaacctataagaattaagtttattaattaggcaatttatgtctgtgataattcttacgggagaaagaggatttgattggaaagcagtttgggaagaaagtgctgctgaaatttccagaatttaattgattggttacataaactttttgacttc

SEQ ID NO: 115910 - DNA, 2479 bp, Homo sapiens
  Payload ID: 2615
  Gene Symbol: CISD1
  Gene Name: CDGSH iron sulfur domain 1
  Uniprot ID: Q9NZ45
  ENST ID: ENST00000333926
  CDS Start-End: 217-543
ggagtccagacttccttatggccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaaaaaaggaaaaaccaacctgcatggcctgtgggttattttggtcttgtaaggatccatttctttaaaatactgacatatagagttgtaccttatatagaatatagttgtatcttgaagtcaacatattaaattattctcaaaattatgtatttgcagattgtacttgtaagtttcaaagaaaaattaccatcttttcatattgacctggaaactaaataggatgtgattcagctacattaatttcttaatacaatctaggaaagacctgttgtagccttgattttcttgacattggtaatgacactgagaaaatatggcttctgtttttcaccgttttcaatcaaaatgattgataaatgttattctgtttaatttcataagtcaggtcaataataaaggggtggtaacttcctcatatttatcttcacagatatttaatgaagatggatccattaaaggagccaatagtgaaaatttagttaaaggtgatattagatttaaattagtcatgaagaatgtcttaaaatctaatgttccagaattctggcccaaggaatggtaagcacttgaactgaggattttgaaggaattggaacatataatgtcaagtcttttgatcactaagccacatatcctgacagaaatagtagtcacaagattagatcaaaggcgtgggaagatttttttttttcccactctagctaatcaagcacatggcttttaaattgtatgatctttttcttaaaagcaaaaatttgaagacaagtgtttgtttatgtaatattcttcaaagactccgagcagaaacattgcattcattgttgattcagaaaaaagaaaatataaaaactgaaaataattagcaataaaagatttaagacaaatagttcataaatatttttaaagagattaggtttttgaatttcataggttagaaggaaaatcatggcaaaatttacagaaaattgggcaaacaattgaaattgataaagcaggtaaacatcatcatttattttagtatacatgaattctcagtagtagtcaatcacaaatttctacttgctaaaatccatttaccttgacaggaatcaaacctgacagcagcatatcctatgtaatatatgatcatggctatttttaaatatgtagttttgtgtattactgtagataaaagttggtaacaaaattgtacagtggttttaagaagcccatgtaactaacttggacatgtctttaagtcacatattcatcataaaatctaaaatcctacaaactgattctattagattcttagggtaaattttttctttgcccacctccttctttttaagataagtatgcatgtcagcaaaacagagcaatcatgcttttaaagatgaactgttttaaagaaaaataaatgcatcaactcccagtgtttctgataaagggacatccttctaacttaacagactattctttatcttgaatttgaaattatattgttagtcatgcatttttgtaatgtcagggggaacctggtaccagttctcaaaactataggattatatgagtgtgtgtatacatatggcaaaattataaatgaccaccttactgtgaaatatagatcttgagcattttgaaaggccaaaataattaggtaaatgtattttcaaggtcatgttaaaatgtttacatgcttttgaactagcattcatttatgattaaaacccttttcaggttatttgacctaaaaaccaaa

SEQ ID NO: 115911 - DNA, 2327 bp, Homo sapiens
  Payload ID: 2616
  Gene Symbol: CISD2
  Gene Name: CDGSH iron sulfur domain 2
  Uniprot ID: Q8N5K1
  ENST ID: ENST00000273986
  CDS Start-End: 108-515
aggccgaggccgccagtgcccgccggccgcttccgctcccggcgcaggcgcggcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtgtattttaaactgactcagtgacagctggggtggaatggcaagaacacttacaaccaaactcatgggctgctgcaatttgaagataattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaattgtacccacccagttcaaacccgtgtgtaagggtcaactgtacaaaaaagtttgtgaaataaacgtactggagaatctttaaaatttttgtgctttttaatcctactattatgaatctttttagtttcatcttacattactactctcataatagctatccttagccaggtgccatggcacaggcctgtagtcccaactgctgggaagattgaggtgggaggatggctgcagtacaagagcccaggagttcaaggccaggctgggcaacctagtgctccgcctctgctgggctctgtagggaatcctttctgttgtaaaagagttaccatttaactcccttcactgagtgcgtttctgagaccttgctaggcactctggaaactgcttagttgagaaaagacaaatacaaaagcttttctttagtctatttaagatacagtttattcagttcactttgctttctttttataagaatgtacaagaggcagacagaggtaatccttctagaaataaaactaattgttattgggcacttgtatgtaccagacactacactaagcatggtacttgggtttttaatttattacatgtaatgtcagtaggttcaattatatgatcgtaacatcttcatgaccagcagcatgtattttagagttagaaatgtagtctggtttttgagaagttttacaaggtgtatgtccaaaattgttctttcctcacatgtcagtgggggataaatacagcattgctctca

SEQ ID NO: 115912 - DNA, 808 bp, Homo sapiens
  Payload ID: 2616
  Gene Symbol: CISD2
  Gene Name: CDGSH iron sulfur domain 2
  ENST ID: ENST00000503643
  CDS Start-End: 45-482
gcagctgcctggggaacgcctgtgaggcagtctccgggtgcttgatgccccagggtcttttgtcctcggagttgtctccggtgtcattccgtggcaagataccaggtttttgcagagaaggtgctgagttgggaacaggccagtctctttcatctcctgtcctgctcatcgctctcttttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcc

SEQ ID NO: 115913 - DNA, 471 bp, Homo sapiens
  Payload ID: 2616
  Gene Symbol: CISD2
  Gene Name: CDGSH iron sulfur domain 2
  ENST ID: ENST00000574446
  CDS Start-End: 32-175
ctcgggagaggagtggacgccgctggccaggatggtgctggagagcgtggcccgtatcgtgaaggtgcagctccctgcatatctgaagcggctcccagtccctgaaagcattaccgggttcgctaggctcacagagtcttgctcttgtcacccaggctggagtgcaatggcatgatctcggctcactgcaacccctgcctcctgaattcaagcgattctcctgcctcagcctcccagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggtt

SEQ ID NO: 115914 - DNA, 2074 bp, Homo sapiens
  Payload ID: 2617
  Gene Symbol: CISD3
  Gene Name: CDGSH iron sulfur domain 3
  Uniprot ID: P0C7P0
  ENST ID: ENST00000613478
  CDS Start-End: 125-508
ctggcctccgccctcgcagaacgccgcggcgtcttccggggcctggcgggccggggaccgagggggcggggaggtgacccggcgggggcggagccagcgggcgggcgcggcgcgggaggcgaccatgcgcggcgcgggggcgatcctgcggccggcggcgcgtggtgcccgggacctgaacccgcggcgggacatctcctcctggctggcccagtggttccctagaaccccagccaggtccgtggtggccctgaagacccccatcaaggtggagctggtggcagggaaaacctacaggtggtgtgtgtgtggccgcagcaagaagcagcccttctgtgacggctcccacttcttccaacgcactggcctatctccactcaagttcaaggcccaagagacccgcatggtggcactctgtacctgcaaggccactcagaggcccccgtactgcgatggcacccacaggagtgagcgcgtgcagaaggcagaagtgggctccccactctgagggggctgctgctgtccagccacaggtggccttggctccaggcctctgacaggcacccccttctgtgggaaaggaaacaggtgctgagcccaagagactctggtacccactgctggctcatgaaggaagaattattccttataacctaaaagtctccagtctggggcaggcgggagtgggccctggttcaatgtttgctgatggggaagatggcaaaaacaagcctgcccaaccagactggtagtcctgcagtcactgctatgaggcccacgtgctgcctcctgctccagattttaacctctctgtgggctgggggcacctgaccagccacaggagagggcagttcagattcattctgtatggggtccccaagccaggctaaacccagagatgagaggcacccttcccttcttccctccaccccaaagaactacaggctccagaaagtatgcagcatttattacaaagccaagagatacagatgtcccagggcaaaggagggtacagtcacaggacctcagacacaggacaaggtgcaaacacagacaagcccatcagggggctcccaaccccacacacctacgctatgatggaatctcgagtctcgactcccgactcctctcagatctatgcacacttgaggaaatctcggtgggcagcgacctgccagggtctgtccctaaggaggtggtccgctgacctctcaaggggtgggggtggggtcagagcttacaggtttctgtcttcttgtgcttttagatgcagttgctctgtcctgaccaggtgaccgggcctcagctgggggtggaggggcaattggaaggctgtttgcctctggcaaagtctgggatctgtgcttgtgtgaggttaacccacccccacttccactctaggccccaggtgagactccaccaccagtcctgctagtgagggttccccggtgagggtaaggttggtgggggtgcagcgcttcacaatgctaaagccttagccctcctccaagagctgagacctctcagggcctgaatcttcttttccacaagataaatgatgcaaaggccacacacacaggaaaaaaaaaaaaagaggcagaactatctattctttgcacaaagtttccactgcaagaggaggaggtgatgcaggtgccacctccaccctgcacttgctcctcagaaccagggataaactgcatttgtaaaaggcactgttcttagcaatttctggacattcaacaacgtggggggcggccactggtcagaggcaggacagcagccaagatggggagagaaacggggagagaaagaaacgattctaactgactcctatatgcagccagttggaatcatgcctaaagctttgggtctgaaggggcccccaacacaccacctgccttgggaaacagcgaggatggtgcagagctttattgagactccagtggcccatccagttcatctccaggcacccccaaaaacagcaaattacacaagaccccccccaaaaaaaatgaacaccattttccacacatacacacacacataaagtttgtttcctgtggcatttaaa

SEQ ID NO: 115915 - DNA, 2074 bp, Homo sapiens; identical to SEQ ID NO: 115914
  Payload ID: 2617
  Gene Symbol: CISD3
  Gene Name: CDGSH iron sulfur domain 3
  Uniprot ID: P0C7P0
  ENST ID: ENST00000620783
  CDS Start-End: 125-508

SEQ ID NO: 115916 - DNA, 11311 bp, Homo sapiens
  Payload ID: 2618
  Gene Symbol: CACUL1
  Gene Name: CDK2-associated, cullin domain 1
  Uniprot ID: Q86Y37
  ENST ID: ENST00000369151
  CDS Start-End: 485-1594
gaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagagtgggttcagatggctccaactctattttctaaatttattccaaacattctccctccggcggtggaatctgaactttctgaatatgctgctcaagatcagaaatttcaaagagaacttatacagaatggttttacaaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttattaagtccaaatacacagtggtgtggggttcctgatcacttcattttaaatgaatgagataattacttaaaaaaagtctgtcatttgaacattatatttgagtgtgatagggaagaagtagcactgctgtcctaaggctcccttccagctgtggcaaagctatatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagtacttaaccagagttcgtggattttgtggactttaattggactcaattcactctgtgagcatcctggattgcatcgatgaacactgaattactgtaagaacatagacaggctctcactatgacctggacagtttaagttgctacactggtaacattctagtatcaaggagaattccattcatcatgacattcacattttacttttctcaatggaatgcttgcttcaggcttaccaatcacacctagaactgaagtctgagtgagtggtattaataatttttctgaaaggaataaaattggaatgtttctaaatgtggagaaattcttcagtatcctaataatatacccaaatgctttttctgggagagagcattcttttacaaaagaactttccctataaaagcatcacagtataatgtgaattggcattaaaatctttggatgcttttgcattattaagttcatggagaaatatattctttttactatgtatgtattaataaaaagtgggcaaagtaaagtttgcaaaatttagtttctctaaatttttgcacagtgactgcagctggctatgggtcagctcttaatacaacaaaaccttgactggaagtcactatagaaaggttgtacatagtctcccagtctacatgtcctggctgttaatcatcttggccccttgaggcacatcacagtttgaaggacctgtttaagttgaaatagactttgcttatttattgggattctaaaaaattctgagtgagtttgcagtatgagaggaaataagatttcctcctccttcctctcattttatattgactgtttgccagaaactgttttcttctgttttcttatattttgtttttgagatggagtctcactctctcacccaggctggagtgcagtggtgcaatctcagctcactgcaacctctgcctcctgggttcaagtgattctcctgcctcggcctcctgagtagctggaattacaggcacgtgccactacgcccggctactttttgtattttgtttttagtagagacggggtttcaccatgttggtcaggctggtcttgaactcctgacctcaagtgatccacccacctcggcctcccaaagtgctgggattataggtgtgagccactgcacctggccttttttttttttttttttgtattcttgccagtacagtatatggtttttctaccccaattacatactgggttttgtaccacatcactaaaggcccaaatcattgaagatacaaaaccgtacatgcaggctggttgtctggttagtcaatggctgatttgcttcaactgtctagtatgtatgtgcagcctgaaactggctccttaaaaggaaagccgggtcagtcatcttgaaaaaatgacatgtaaaagtaaatcgataattgttttgagagacggtacatgttttaaaggttggccttaagcttcagtaacattgtcattttgtgaccttttgttgtcacacctgtaccctaacctgacaggaattaactactgtttttttgtggggcagaaagcaaaacctggtgttgtgacttttatcctaatggttcttaggcaaggttagtgagaagaaacacaaacccagatgcatgcattgtgcattattttgtagacaagctactttttcttctgtccctttaacaaatttgcagcaattaccctccctttggggtctagagtgaaagctaatttgtgggtagatgagattgcagaagaatggatgtccatggctgtgaacactgcacactgcacatccatctccagtgctcacactgtgcagctaccactccctggctgcgtgccatgctgtcgggttgcagatttgcacacataaattcctcaggaagagtttgcatgagcatcacctcgcaatattctgtactgaccaaacaagggatttgaacgtttttcagcacaaaaggataacttccgagtggtggtctgtacgcatactagcaaaggtaatggtgatctagcaaacaaaattggtttctgcagttagaagtgagcaggagcacttgtattatagtatttaaataatcctggttaatctctttttaagccgagtaacccctccagattttgcctttttattattgaggctggctttattttcttctactttttttcccgttttatagcagttaattatttttgtgattattatgcaagaagcattgcccttgagttaaactgttattgtttcataagcagctattaaaataactgagcattgttttatgaacatacactaatctgagatactgaaaagctttgcaactaaaaagcaaaacaacctacattagtcatctagccattgtttggatgttttgagttgattttttatggtgcctcttttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcattaccccactgaagttcaccccagtttctggccacaagaatatgagaaaggaaccctgttgttttccaagggaaatcattcctctctgtccccactgttgattaactaaagtcctggacaccttccttcctccactggccaagacccaccttgacccaccttgaacctcttttcagagccgagtggcatgaatatgtgtactgtttctgcttctgttgatggagtggctgtgggagaattaaaggaaatgctaatttgagcttcattcataggggaacctactatatattgcatccctgctggttggaaattatcttcatctctggactgcattgtttagaaaaatgttaatggcttacaattctgagaactttattgtgtggctctggggttaagaattctgtggtttgaaaaaaaataaatattttgtattgattctcacgtcatttcaatgttgtgactatgtactaaatgcactaagactgggtattctcttagaagagtgcgttttgttaaacagatggcagttcactctcattagttctatttgtcaatattacagccacacacttcaggataacttactcaaatgtgaagtcatgggaagctatggctagtaacaggaatgcttatgaaaaatttggagggcaagcacgagcaagaggcttttgccactcactagcacagccagagcaaggatgaagcaatgaagtcttgttcctagtggtgcttgtatgtcagaagccatagtgagctcagcacagggcgttctgcacatcatctctttaatccaagaaaaacaaaatggcggatgaaactcctattgacctgggatacaaagccactgactttggctcttgatcttttggtgggttctgaatcactccttctgtattagggcatatactttcactctaaaacattgtggtaaatgaaataaatcttgtacagatgtcgttggccttgttatgttatgttataaatcctgtacagatgtccttggccttaatacctggttcactggaactttgttataatatagaatatttgattttgcttatagcatattaatattgcctcctacatgacagccacactgagcacacatctgttaccacagttacttagcctgcagggtgagtgttgatcttgacttctgcaaccagtgctaaaaaacagtgtgtaacaatatacatatggtcatatctattctatattcatatatagtatggatacggatatcagtatatttgtagtttttgttttttaaacactgtacagtttcttctgtggacctttaatcaacttttggacttaggttgtttttttctttgcatttattggtactatgcttttttataaccctttgtgttttcttgctatgaaattagtgtcatcccctaggttatttgtaaccttactttaaggttttagtttctcttgctatctctgtagaggtgtcctttcctacagtattgtcagaatgccagttctcatcccttccatttttttgacctcagctctgttgtgatgttatctactttttggttatcacatgtggcagaattcagtgactctgacaatttccattttcactcccctgccccacagttaagtagggtgtcatttaaactctttcccttttagcaggtttgttttttactaagtacaaaccttttctactagaaccagctctgtgtgtgtgtgtgtatatgtgtgaattttatttcttcgattggcctgtttctcaattatctaaaattctaaaataccttgaatatcaaaaagcatgatagtagaatgaatatcacacatattaatagaacctgagagcaactagcttaactagctgtagtcttgagtaggttttttttttaatctgttttcctttattaagccctctccctccctaaattgttaagccagaagggcataacaattcaaaactttctagtaatgtacctacatgtctaatagtatacctcaaaatatgtaaagaaaaagtggctcacacctgtaatcccaacactgagaggctgaggtgggaagattgcttgaagccaggatttgagaccagcctgggtaacacagaaccccatctctacaaaaaaattttttaaattagggccgagcatggtggctcacgcctgtaatcccagccctttgggaggctgaggtgggcgtatcatttgaggtcaggagttcaagaccagcctggccaacatggtgaaattccatctctactgaaaatacaaaaattagctgggcgtgggggtacacgactgtaatcccagctactcgggaggctgaggcaggaaaatcgcctgaacccaggaggcagaggtttcagtgaaccaagattgcactattgtactccagcctgggcgacaagagtgaaactatctcaagcaaaaaacaaaaaaagttgggcctggcacagtggctcttgcctgtaatgtcaatactttgggaggctgaggcaggtggatcacttgaggccaggagctcgagaccagcctggctaacatggtgaaaccctgtctctacaaaaaataaaaaataaaaataaattaaaaaaaaattaggcatggtggcatacacctgtaatcccagctgcttgggtggctcaggcacaagaacttgaacccaggaagtggaggttacagtgggctaaggtcacaccactggactctggcctgagcaacagagcgagactctgtctcaaaaaaacacaaaaaaagttgggcgtggtggtacctgcttttagtcctagttatttggaggctaaggtgtgaggcaggaggattgcttgagcccaggagtttgaggctgcattgagctatgatgataccactgcatttcagctaggataacagagtgagaccctgtcgagaaaaatatttaaaaagttaaaagaaaactacaaaaaggaaaaatgaacacactacaaagagaaataggtcagtctaccaacataatgggcattttcaacatacccctctcagtaattaatagatcttgcagagactaaattatgaagattattaaggacatagaagatttaaatagtacagctaatcaatttgatctgacagatacataacacacacatacataaaacacattgtacccttcagtaggaaaataagtttttgcaaaccaagtctaacagtgtattcaaaatgtaacaaatgatgaccaaaatggattggtctcaggaatacaagattggctttttaatgtaattaagaaatgctgtttataataggacaagaaaaagtacctaagaataaattttaaaatgagaaaatgataaaaaaaaaacttaatggacctaaataagtgtagagaatataagggataacactcaatattatctaaatctcaactttttctccaaattgcaattccaaaaaaattcccaatgattttcactgtggaacctgacaatttgattcgtcgatataaatggaagagcaaagggccaaggatatccaagacctttctgaatggattgtgaggggaactagcactacaagattctaacacttactgccaaaggtagtgattaaaacaatgactttggagtagggaagaatttcatcaacaagatagaaaatgcagactatcagtagataagtaatttggctaccattgattgtaagtacttattaccaaacatgctgtagagtgaaaagagaagccaaatctggaataagatacaaatattcataatataactgctaaagagcacctgaatgcaaatcagcaatgaaaacaactcaggagagacggaccccaaacactagcaggcatttcacagaagaaacagaaatggcccataaatgtgaaaagatgttcagcctcattagtcgtcaggtaatgcacattaaaagcatagataccatttccttgctgacaacttggcagaaattatgagaagtctgaaaataacaatctgagagtttatgacaacaaaccttcacctgttgttggcgtgtaaatctgcacttctactttggagaacagtattatctaatgaaattgagcataggcacctcttaatagcccactatttatacttagaaaaactcatgtgcatgtgtaccaagaaacgtatacagggatgtttataacagcattatgtgtaataattaaaaggaatgaaggagggagccaaatgcccatctagcatacagtgaataaatgaagtgtatgctgtggaattctctagagtggtcaaggcatcataccactgcgggcttcaacatggatgcatctcagaaatcattgagtgaagtcagaatagagccagcatgggtacctttatgtaaagttcaaaatcagaaaaaactaagtatattgtttagggactcagacacaagtagtaaagctataaaggaaagacagttattaacattcaggaacatagtttcctcaggagagggtggtggaggggaatgagaacagaggggagaacggggacttggaagcacttcataatatgaacgtttggaccattctaaacatgccagttctctgagttaatgtatattcagtgtaaagccaattcagataaccaacagtatttatataatctaaaaaactcatggaagtataaacagatgaaaataggaaaatccccattgaaagtgaagaaaatggaaggaacttgctgtaccaaaaaaaatcactttctaagtgcaattaaattaaaagacttatgccagggtaaacagataagtcaatggaaggtaatttagaaaatagaaaactcaaatttagaatttagagtacactaaaggcggctttttgaaatcatgctgtccatggtcaattattttatgaaaggtgctggtataattagagaacattaaactgattcctatcataccattcaccaagagaaattccagattgtgaactaaaaaagaaaaaaatgttgtaaaaactagaaagtagtattttttcttgggattggagaagttttttctaagaatacaagcaatgaaaccgaaaaccctattaaactcactcacctgcctttaatgccgtagtgtgcacaccccagtgtgtgtgtgtgtgtgtgtgtgtgtgtgtgtgtacatagacatatatattttaaaatgtttaaatttgaacatatgttaccaatacatataaagcaaaagtagaaaatcaaaaagatgaagtaaaaatgttttaaaatattgtttgtggtatttgtggttaataaacctttgctctttctaaaaaaatgttcttttagagagagtcatgattaaaaatgcttgtcatttttgaaactcctagttttaacactttataaaaacaacttaatgttcttaaggtaagtttattttcatgcttggttttaatgactattgtagctgaataagtcacttcattaattaagatctgtggatccaaatatggctgtgcttactgaaaatatttttgagttccatccaccaattttgcaaaagtgtgttgttgaaatttttataataaattttcatcttttccaatgtca

SEQ ID NO: 115917 - DNA, 3217 bp, Homo sapiens
  Payload ID: 2618
  Gene Symbol: CACUL1
  Gene Name: CDK2-associated, cullin domain 1
  Uniprot ID: Q86Y37
  ENST ID: ENST00000493518
  CDS Start-End: 488-1399
cgtgaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagtttctcagaattttacagcagtgtgatgaagatggctcctgaaatagtagtgggttcagatggctccaactctattttctaaatttattccaaacattctccctccggcggtggaatctgaactttctgaatatgctgctcaagatcagaaatttcaaagagaacttatacagaatggttttacaaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttattaagtccaaatacacagtggtgtggggttcctgatcacttcattttaaatgaatgagataattacttaaaaaaagtctgtcatttgaacattatatttgagtgtgatagggaagaagtagcactgctgtcctaaggctcccttccagctgtggcaaagctatatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagta

SEQ ID NO: 115918 - DNA, 5002 bp, Homo sapiens
  Payload ID: 2619
  Gene Symbol: CABLES1
  Gene Name: Cdk5 and Abl enzyme substrate 1
  Uniprot ID: Q8TDN4
  ENST ID: ENST00000256925
  CDS Start-End: 1-1902
atggcggcggcggcggcggccgccaccacggccgcctgcagcagcggcagcgccggcaccgacgccgcgggcgccagcggattgcagcagccgccgccgcagccccagcctcagcccgcggccgccgcgccggcccagccgccgcccgaacccccccggaagccgcgcatggacccgcggcgccgccaggctgccctctccttcctcaccaacatctcgctggacggccggctgccgccgcaggacgcggagtggggcggtggcgaggagggcggcgcggccaagccgggcgccggcggcgcctgcggcgcgaggactcggttcagcttgctcgccgctgccgagcggggcggctgcatcgcgctcgccgcgccgggcacgccggctgcggggttagccgctgggtccggcccctgcctcccacagccctcgtcgctgccgcccttgattcctggcggccatgcgaccgtgtccggccccggggtggcgcgggggttcgcgagtcccctgggcgccggccgggcgtcgggggagcagtggcagccgccccggccggcgcctctcgccgcctgtgcccaactgcagctgctcgacgggtccggggccgccgggcaggaggagttggaggaggacgatgcctttatcagcgtgcaggtgccggcggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatcgctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtatacctgtatgcgtttgtgtagacgtgtgtctcaccagtcacctttgccctgcattgctgatccccttgcgcacactgattctagtgaggtcacagattcggagcttcacacaccagcccagagaaagggcgatggaaccgaaccgagggtctgcagctttcgttagcagagctgtcagattcttgacagtcttggaggatggagaaattcaagcagcagctggtgagggccaaaacagaatacttggcttcttcagaatcttagattgcactgagtttagtcctaaatattttgctaacaaatttccttggccagaatcagttgtaagacagtgatttgggtggtggggggagggaggagggagaggatatgattaatgtggtctctttggctgatcgaaagctagatcaactggtacttagggcacttgctgtttataaagcaaaattgagaaaatattcaaggtgcctccatcgcctgaactacaaaatgcccttggccttcctcacatggggtctgtcaccttgcatctctgataagccatccaccttcctggtcagtgcctacagggggagagcctttctgagaagcaggtcctgtggtatctgagaatggtctagagagctccccactgcccatctgcccccgaatttcctgccaagctctggggagtggggtggggggagggacgtccgatggatgacaggccgccagcccagacgtggggagagaagcctgagtcctttcctgtgtgataaaatcaggctaatttacttggatttggggtgatttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtggaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgccctttgacctcctccacagagggcagcttcagccccttgtaagccctgccccctctcaggactgccctgaggcctctccagtcctccccacactcagagatctgtggggaagctccgcccagccacactccttgggataatactagccggttctgcctgattccttttcccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttcttgcccgctaataaaacctatttaaacaggaaattcataccaaatgcaaatgggttttgttttccttggcattttgttgttccgatcacagatttccctgccagggtgtctgtggttatcagctgcaggctcagcttggggcggccgcttcacacaagccactctgtaccacgtgccctaccttagtgacgggagtaaggagcttccttcccctccatgtcattccttcctgttcccttcattccccaacagcaaataaaactgttgaatgct

SEQ ID NO: 115919 - DNA, 1544 bp, Homo sapiens
  Payload ID: 2619
  Gene Symbol: CABLES1
  Gene Name: Cdk5 and Abl enzyme substrate 1
  Uniprot ID: Q8TDN4
  ENST ID: ENST00000400473
  CDS Start-End: 244-1164
gtgcttatgagataaacgacagggtaactgtccacattggtcccagtttatgagggagaagagatcataatctacaaaaatttgcaaggtgaccaggggaaaagagtacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatac

SEQ ID NO: 115920 - DNA, 2471 bp, Homo sapiens
  Payload ID: 2619
  Gene Symbol: CABLES1
  Gene Name: Cdk5 and Abl enzyme substrate 1
  Uniprot ID: Q8TDN4
  ENST ID: ENST00000420687
  CDS Start-End: 79-1185
ggccatttttcttcctggtgtttgaatgactcataaaatgagtttggagtggtctgaagcctctgcctccttccttgaatgctttctaagaggggctgccatgcaagaatatatgctgattttcccatacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatcgctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgta

SEQ ID NO: 115921 - DNA, 343 bp, Homo sapiens
  Payload ID: 2619
  Gene Symbol: CABLES1
  Gene Name: Cdk5 and Abl enzyme substrate 1
  ENST ID: ENST00000580153
  CDS Start-End: 315-343
acctataaatacggacacccggccccggagcccgcgagccagcggccaggcgaccggcgggcggccagccagcgagccgaactagccgagctaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcag

SEQ ID NO: 115922 - DNA, 2074 bp, Homo sapiens
  Payload ID: 2619
  Gene Symbol: CABLES1
  Gene Name: Cdk5 and Abl enzyme substrate 1
  ENST ID: ENST00000579963
  CDS Start-End: 225-341
gtgcttatgagataaacgacagggtaactgtccacattggtcccagtttatgagggagaagagatcataatctacaaaaatttgcaagacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatcgctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtat

SEQ ID NO: 115923 - DNA, 604 bp, Homo sapiens
  Payload ID: 2619
  Gene Symbol: CABLES1
  Gene Name: Cdk5 and Abl enzyme substrate 1
  ENST ID: ENST00000582882
  CDS Start-End: 1-491
cggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcgggtatgtatatgcatgcatgctttgtagttctctgggtgaaaagatctcacaccaatgtacataatgtggccatcctttccattttcaagaagttgccttgctttgatactgcaaattcagtatttgtacactggaatgataaaaagatgttccactttcttttcagccagaaagctt

SEQ ID NO: 115924 - DNA, 3785 bp, Homo sapiens
  Payload ID: 2620
  Gene Symbol: CABLES2
  Gene Name: Cdk5 and Abl enzyme substrate 2
  Uniprot ID: Q9BTV7
  ENST ID: ENST00000279101
  CDS Start-End: 10-1446
agtctgaggatggccgcggccgcggccggtggagccccgggcccggcccccggccccgccgggcccccgccacccgccgcgccgacctcggccgctcgggccccgccgcaggcgctgcggaggcgcggggactcgcggcgccgccaggccgcgcttttcttcctcaacaacatctccctggacgggcggcccccgagcctgggcccgggcggagagaagcccccgccgccgcccgccgaggcccgcgaaccgccagcgccgccgccgccggagccccccaccgggctgcccgccaggacccccgcgccccagggcctgctcagccccacgcaggtgcccaccggcctcggcctggatgggcagcgccagaggaagcgagtcacgtcccagcgctgctccctggagtttctggaagatgccgtgggatgcgctccagcacagagaaccaaacacacatctggatcaccgagacataaaggcctgaagaagacccacttcatcaagaacatgaggcagtacgacaccaggaacagcaggatcgtgctcatctgtgccaagcggtccctgtgcgcggccttctcggtcctgccctatggggaaggcctgcggatcagtgacctgagggtggacagccagaagcagaggcacccgtccggcggcgtctctgtgtcttccgagatggtctttgagctagaaggtgtggagctaggagcagacgggaaggtcgtgtcttatgcgaagttcctgtatcccaccaacgccctggtcacacacaagagtgacagccatggcctgctgcccacacctcggcccagtgtcccccggactctgccagggtcaagacataaacctgcccccaccaagtcggcaccagccagcacagaactagggagtgacgtgggggacaccctggagtacaaccccaacctcctggatgacccgcagtggccctgcggcaagcacaaacgtgtcctcatctttgcgtcgtacatgaccacagtgatagaatacgtgaagccctcagacctcaaaaaggacatgaacgagaccttcagggagaagttcccccatgtcaaactgacgctgagcaaaatcaggagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgacgcagctcatcgataagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactggaatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacacttgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggctctgggacgactttgtctctagcccattaatacaatacatcctatgctttctgtgcagactggtgcttccgcagaaaggagatgccaattctgctatcacagaactccaccagcaactccacccgaccccagcagtggtgcaggacagctgccagcacccacctggccctcctccttttccacagccactcactggggccaccaaaacccagagatggcaggtgtgtgggacagactggaggatgaggacaaaccaaagcctttgttctttcttattgtggagcgtccccttccatcaagcagcctgccctcaagccaaggatcatcccctggaacccagtatgcacccagaggggactcagcttcaaagctgctccaccatgctgggtcccaggcagctttcctctgaaaagcaacctctcctgccacccagatcccatctcaagagctcgcccatgttacgagcatgtaaaggactgacttcctagtaactgttgcagtttacaacctgccctccagggacacgtctccatggtttttcctacacatgaatgcgagaaatggctgataagcacagtaatttaagattgcgtattcatgtagtgagatttagtcattaaccaacccggtctttgtgatgtgtgaagccttcccttcagttatgtcccatttttatgatgccaaaagctgccactgtgtggtattcgaggattattgcaacaaagccagtagttaaaccaaactacagtctcagcctgtcattctctagaacacatccaggtgtcggagctaaggtgttcagctcggctgtgactatacagaaccaggcctggcgttgcttccgcaccggtagcagttgtggatgtcagtgtgcataagcaagtatcagacctcagaatgtttgagttattttgtcttagatatctgtttttaaatggataatgtatttgtcctttaaacctcagttttgcaata

SEQ ID NO: 115925 - DNA, 775 bp, Homo sapiens
  Payload ID: 2620
  Gene Symbol: CABLES2
  Gene Name: Cdk5 and Abl enzyme substrate 2
  ENST ID: ENST00000453274
  CDS Start-End: 1-775
gacaccaggaacagcaggatcgtgctcatctgtgccaagcggtccctgtgcgcggccttctcggtcctgccctatggggaaggcctgcggatcaggtcgtgtcttatgcgaagttcctgtatcccaccaacgccctggtcacacacaagagtgacagccatggcctgctgcccacacctcggcccagtgtcccccggactctgccagggtcaagacataaacctgcccccaccaagtcggcaccagccagcacagaactagggagtgacgtgggggacaccctggagtacaaccccaacctcctggatgacccgcagtggccctgcggcaagcacaaacgtgtcctcatctttgcgtcgtacatgaccacagtgatagaatacgtgaagccctcagacctcaaaaaggacatgaacgagaccttcagggagaagttcccccatgtcaaactgacgctgagcaaaatcaggagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgacgcagctcatcgataagttagaagaaaggtttcgattcaacaggcgcgacctgatagggtttgagttcacagtgctcgtggccttggagctggccctgtatcttcccgagaa

SEQ ID NO: 115926 - DNA, 2122 bp, Homo sapiens
  Payload ID: 2621
  Gene Symbol: CDK5RAP1
  Gene Name: CDK5 regulatory subunit associated protein 1
  Uniprot ID: Q96SZ6
  ENST ID: ENST00000346416
  CDS Start-End: 155-1918
agcatgacccggcctgaagtagcggcggaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacatgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 115927 - DNA, 1891 bp, Homo sapiens
  Payload ID: 2621
  Gene Symbol: CDK5RAP1
  Gene Name: CDK5 regulatory subunit associated protein 1
  Uniprot ID: Q96SZ6
  ENST ID: ENST00000339269
  CDS Start-End: 155-1687
agcatgacccggcctgaagtagcggcggaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacatgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 115928 - DNA, 2164 bp, Homo sapiens
  Payload ID: 2621
  Gene Symbol: CDK5RAP1
  Gene Name: CDK5 regulatory subunit associated protein 1
  Uniprot ID: Q96SZ6
  ENST ID: ENST00000357886
  CDS Start-End: 155-1960
agcatgacccggcctgaagtagcggcggaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacatgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggtgttcctcccacctcggcctcccaaagtgttgggattacaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 115929 - DNA, 974 bp, Homo sapiens
  Payload ID: 2621
  Gene Symbol: CDK5RAP1
  Gene Name: CDK5 regulatory subunit associated protein 1
  ENST ID: ENST00000427097
  CDS Start-End: 1-770
gctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 115930 - DNA, 1930 bp, Homo sapiens
  Payload ID: 2621
  Gene Symbol: CDK5RAP1
  Gene Name: CDK5 regulatory subunit associated protein 1
  Uniprot ID: Q96SZ6
  ENST ID: ENST00000473997
  CDS Start-End: 233-1726
gtatgaacgcagcggcggacctgtgaggggatccgacttgccggcagaacttacgctgcgggaccccgggcactgttgctgctgcgggagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacatgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 115931 - DNA, 3272 bp, Homo sapiens
  Payload ID: 2622
  Gene Symbol: CDKAL1
  Gene Name: CDK5 regulatory subunit associated protein 1-like 1
  Uniprot ID: Q5VV42
  ENST ID: ENST00000274695
  CDS Start-End: 168-1907
aaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaagattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcatttttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccggcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatagaattggtatactaagcaaa

SEQ ID NO: 115932 - DNA, 3115 bp, Homo sapiens
  Payload ID: 2622
  Gene Symbol: CDKAL1
  Gene Name: CDK5 regulatory subunit associated protein 1-like 1
  Uniprot ID: Q5VV42
  ENST ID: ENST00000378610
  CDS Start-End: 11-1750
ggtagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaagattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcatttttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccggcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatagaattggtatactaagcaaa

SEQ ID NO: 115933 - DNA, 1673 bp, Homo sapiens
  Payload ID: 2622
  Gene Symbol: CDKAL1
  Gene Name: CDK5 regulatory subunit associated protein 1-like 1
  Uniprot ID: Q5VV42
  ENST ID: ENST00000613575
  CDS Start-End: 257-550
gtcatggcgctctccatctaaagtctgtgcagcttccggagagtggcgggttgattttctcactttggactggtttttacttcccgacttctggtggttggttactcgcactatgcagacgtgttgcggtgctgaatacaacatttattactaaagccagacactggatcaccgtcacggcagatgtcagcacacctgttgtaatcaactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacaggtgaatgaaatttgggaatcctatacttggaattctggaatggctagcctgggccaggaaaaatcactttgtaatctaagaaggaattgagttaagaagatttgttcatcacaccacatttccatgttgttgaggaaaatagattggcagtggtgacaaggtcaaggatgtgttgttcgaagttgtagaagataagcagcaatttaaaggcgttacaatacatttttaagagtggaaattgcattgaagagtggaagaaaagtcgacataagagaattagggcatgttgtttgcccaggctggtcttgaactcctgagctcaaccaatccacctgcctcggcctcccaaagtgctgggattacaggcgtgagccaccgtggctggcccttaatatgttttaaaaggatgtttaatactcttcattactgtgttatgcaatagttgcatgatgatttttctgatctctacattctattttttttctttttaaaatggagcacagaagtacttagtttctgatgtttttccatcttggcccagtaatttcctttttttttgttattttatgaagcacaaaactaaatatttttgaaccaagagactactgtgtggtattaattttgattttgtactaaattcatgttatttacacaaatcaaatagtgtcaaccttaaaatttttttaagcaatatttttcttatgtttgagagttaacatgtatggttgattagaatcttcaccttctaaagggattaaggaaaaacctcgttcactgttgtgaattctaaaatgttttggttccaagtcctagtttttcttaccctggtattatgtccaaaatgaatgcccactaaaagttagtaactctcatggcaattaaagtattttgataatgtttataagttcttgttctcaattttgccactagtaaagatgtgggagaagttaatctttttttgttgtctttcttgtgaacttaaagatcatttttcatcctgttcaacctttggcctgaccttttcaggtcactaaatgtctggtttgcacttcttgtagcatgtgagaaataatacttcaaaattcaagtgtaattgtattaatttttgtgaataaactgctatggagtgct

SEQ ID NO: 115934 - DNA, 6228 bp, Homo sapiens
  Payload ID: 2623
  Gene Symbol: CDK5RAP2
  Gene Name: CDK5 regulatory subunit associated protein 2
  Uniprot ID: Q96SN8
  ENST ID: ENST00000349780
  CDS Start-End: 181-5862
ggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaccttg

SEQ ID NO: 115935 - DNA, 5985 bp, Homo sapiens
  Payload ID: 2623
  Gene Symbol: CDK5RAP2
  Gene Name: CDK5 regulatory subunit associated protein 2
  Uniprot ID: Q96SN8
  ENST ID: ENST00000360190
  CDS Start-End: 181-5625
ggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttc

SEQ ID NO: 115936 - DNA, 5551 bp, Homo sapiens
  Payload ID: 2623
  Gene Symbol: CDK5RAP2
  Gene Name: CDK5 regulatory subunit associated protein 2
  ENST ID: ENST00000360822
  CDS Start-End: 193-5184
ctcgtttccgtaggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagaggaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaccttga

SEQ ID NO: 115937 - DNA, 3902 bp, Homo sapiens
  Payload ID: 2623
  Gene Symbol: CDK5RAP2
  Gene Name: CDK5 regulatory subunit associated protein 2
  ENST ID: ENST00000416449
  CDS Start-End: 1-3864
gacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccac

SEQ ID NO: 115938 - DNA, 2747 bp, Homo sapiens
  Payload ID: 2623
  Gene Symbol: CDK5RAP2
  Gene Name: CDK5 regulatory subunit associated protein 2
  ENST ID: ENST00000425647
  CDS Start-End: 1-2712
aatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccc

SEQ ID NO: 115939 - DNA, 970 bp, Homo sapiens
  Payload ID: 2623
  Gene Symbol: CDK5RAP2
  Gene Name: CDK5 regulatory subunit associated protein 2
  ENST ID: ENST00000481266
  CDS Start-End: 84-911
ggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgagtagtgggggaaggagagaaacagctttgaagagaggatccaggcacttgaagaggacctgag

SEQ ID NO: 115940 - DNA, 5826 bp, Homo sapiens
  Payload ID: 2623
  Gene Symbol: CDK5RAP2
  Gene Name: CDK5 regulatory subunit associated protein 2
  ENST ID: ENST00000480112
  CDS Start-End: 28-2277
accaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatgtgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagacatcactgacttattcatacatattcatgctgcacacttttttgggttgcattttcacaccattccatgctccatgtagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccg

SEQ ID NO: 115941 - DNA, 5956 bp, Homo sapiens
  Payload ID: 2623
  Gene Symbol: CDK5RAP2
  Gene Name: CDK5 regulatory subunit associated protein 2
  ENST ID: ENST00000473282
  CDS Start-End: 28-1410
accaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatgtgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtggtctcactctgtttcctgggctgttcctgaactcctgggctcaagtgatcctcccacctcagtttcttgagtagctgggattataggcacatgccaccatgcccacctcactgattgttcctgatagaggatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagacatcactgacttattcatacatattcatgctgcacacttttttgggttgcattttcacaccattccatgctccatgtagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccg

SEQ ID NO: 115942 - DNA, 565 bp, Homo sapiens
  Payload ID: 2623
  Gene Symbol: CDK5RAP2
  Gene Name: CDK5 regulatory subunit associated protein 2
  ENST ID: ENST00000482047
  CDS Start-End: 166-565
agaaaactggagccagagtccttggttttgccctggtgagacggatccagatctgcgacacagattgactcactgttgggcagggcaagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagcccttt

SEQ ID NO: 115943 - DNA, 1866 bp, Homo sapiens
  Payload ID: 2624
  Gene Symbol: CDK5RAP3
  Gene Name: CDK5 regulatory subunit associated protein 3
  Uniprot ID: Q96JB5
  ENST ID: ENST00000338399
  CDS Start-End: 107-1627
aggatgcccgtttgtgtctaaacggaggctcggccacaacgccactggattggtggtagggcggggcgggccacagtctccagcctgaagcggaagtggaggaaagatggaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaaggacctgccgagtcagctggctgagattggggcagcggctcagcagtccctgggggaagccattgacgtgtaccaggcgtctgtggggtttgtgtgtgagagccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcgattgactggggcgactttggggtagaggcagtgtctgaggggactgactctggcatctctgccgaggctgctggaatcgactggggcatcttcccggaatcagattcaaaggatcctggaggtgatgggatagactggggagacgatgctgttgctttgcagatcacagtgctggaagcaggaacccaggctccagaaggtgttgccaggggcccagatgccctgacactgcttgaatacactgagacccggaatcagttccttgatgagctcatggagcttgagatcttcttagcccagagagcagtggagttgagtgaggaggcagatgtcctgtctgtgagccagttccagctggctccagccatcctgcagggccagaccaaagagaagatggttaccatggtgtcagtgctggaggatctgattggcaagcttaccagtcttcagctgcaacacctgtttatgatcctggcctcaccaaggtatgtggaccgagtgactgaattcctccagcaaaagctgaagcagtcccagctgctggctttgaagaaagagctgatggtgcagaagcagcaggaggcacttgaggagcaggcggctctggagcctaagctggacctgctactggagaagaccaaggagctgcagaagctgattgaagctgacatctccaagaggtacagcgggcgccctgtgaacctgatgggaacctctctgtgacaccctccgtgttcttgcctgcccatcttctccgcttttgggatgaagatgatagccagggctgttgttttggggcccttcaaggcaaaagaccaggctgactggaagatggaaagccacaggaaggaagcggcacctgatggtgatcttggcactctccatgttctctacaagaagctgtggtgattggccctgtggtctatcaggcgaaaaccacagattctccttctagttagtat

SEQ ID NO: 115944 - DNA, 1975 bp, Homo sapiens
  Payload ID: 2624
  Gene Symbol: CDK5RAP3
  Gene Name: CDK5 regulatory subunit associated protein 3
  Uniprot ID: Q96JB5
  ENST ID: ENST00000536708
  CDS Start-End: 110-1705
aatgtaggtgttctctttgggacgtctcaccgactctcttccttccccttccctgccctaatcgcccaacacgttgcaggtgctcaaccatgtctattagagaaactgaatgaggaggcaaagcatgacaagtgccacaagagacctgcacactgctctggatggtaaagcgacgcaaggagggaagaaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaaggacctgccgagtcagctggctgagattggggcagcggctcagcagtccctgggggaagccattgacgtgtaccaggcgtctgtggggtttgtgtgtgagagccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcgattgactggggcgactttggggtagaggcagtgtctgaggggactgactctggcatctctgccgaggctgctggaatcgactggggcatcttcccggaatcagattcaaaggatcctggaggtgatgggatagactggggagacgatgctgttgctttgcagatcacagtgctggaagcaggaacccaggctccagaaggtgttgccaggggcccagatgccctgacactgcttgaatacactgagacccggaatcagttccttgatgagctcatggagcttgagatcttcttagcccagagagcagtggagttgagtgaggaggcagatgtcctgtctgtgagccagttccagctggctccagccatcctgcagggccagaccaaagagaagatggttaccatggtgtcagtgctggaggatctgattggcaagcttaccagtcttcagctgcaacacctgtttatgatcctggcctcaccaaggtatgtggaccgagtgactgaattcctccagcaaaagctgaagcagtcccagctgctggctttgaagaaagagctgatggtgcagaagcagcaggaggcacttgaggagcaggcggctctggagcctaagctggacctgctactggagaagaccaaggagctgcagaagctgattgaagctgacatctccaagaggtacagcgggcgccctgtgaacctgatgggaacctctctgtgacaccctccgtgttcttgcctgcccatcttctccgcttttgggatgaagatgatagccagggctgttgttttggggcccttcaaggcaaaagaccaggctgactggaagatggaaagccacaggaaggaagcggcacctgatggtgatcttggcactctccatgttctctacaagaagctgtggtgattggccctgtggtctatcaggcgaaaaccacagattctccttctagttagtatagcggacttaataaaagaggaaaaaactctt

SEQ ID NO: 115945 - DNA, 1862 bp, Homo sapiens
  Payload ID: 2624
  Gene Symbol: CDK5RAP3
  Gene Name: CDK5 regulatory subunit associated protein 3
  ENST ID: ENST00000584991
  CDS Start-End: 99-416
cgtttgtgtctaaacggaggctcggccacaacgccactggattggtggtagggcggggcgggccacagtctccagcctgaagcggaagtggaggaaagatggaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggcaagattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaaggacctgccgagtcagctggctgagattggggcagcggctcagcagtccctgggggaagccattgacgtgtaccaggcgtctgtggggtttgtgtgtgagagccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcgattgactggggcgactttggggtagaggcagtgtctgaggggactgactctggcatctctgccgaggctgctggaatcgactggggcatcttcccggaatcagattcaaaggatcctggaggtgatgggatagactggggagacgatgctgttgctttgcagatcacagtgctggaagcaggaacccaggctccagaaggtgttgccaggggcccagatgccctgacactgcttgaatacactgagacccggaatcagttccttgatgagctcatggagcttgagatcttcttagcccagagagcagtggagttgagtgaggaggcagatgtcctgtctgtgagccagttccagctggctccagccatcctgcagggccagaccaaagagaagatggttaccatggtgtcagtgctggaggatctgattggcaagcttaccagtcttcagctgcaacacctgtttatgatcctggcctcaccaaggtatgtggaccgagtgactgaattcctccagcaaaagctgaagcagtcccagctgctggctttgaagaaagagctgatggtgcagaagcagcaggaggcacttgaggagcaggcggctctggagcctaagctggacctgctactggagaagaccaaggagctgcagaagctgattgaagctgacatctccaagaggtacagcgggcgccctgtgaacctgatgggaacctctctgtgacaccctccgtgttcttgcctgcccatcttctccgcttttgggatgaagatgatagccagggctgttgttttggggcccttcaaggcaaaagaccaggctgactggaagatggaaagccacaggaaggaagcggcacctgatggtgatcttggcactctccatgttctctacaagaagctgtggtgattggccctgtggtctatcaggcgaaaaccacagattctccttctagttagtat

SEQ ID NO: 115946 - DNA, 560 bp, Homo sapiens
  Payload ID: 2624
  Gene Symbol: CDK5RAP3
  Gene Name: CDK5 regulatory subunit associated protein 3
  ENST ID: ENST00000579605
  CDS Start-End: 70-426
aacgccactggattggtggtagggcggggcgggccacagtctccagcctgaagcggaagtggaggaaagatggaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttaggtggtaaaatcaattgtttttgatggaattgattttccctgagtggagtgctgggggaaggaggaggtccaggccggtagtggccattcgccgtgcctcagcgagcagcagattgccaagtgccagcagctgcagcaagaatacagccgcaaggagg

SEQ ID NO: 115947 - DNA, 564 bp, Homo sapiens
  Payload ID: 2624
  Gene Symbol: CDK5RAP3
  Gene Name: CDK5 regulatory subunit associated protein 3
  ENST ID: ENST00000578525
  CDS Start-End: 26-400
agcctgaagcggaagtggaggaaagatggaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaag

SEQ ID NO: 115948 - DNA, 558 bp, Homo sapiens
  Payload ID: 2624
  Gene Symbol: CDK5RAP3
  Gene Name: CDK5 regulatory subunit associated protein 3
  ENST ID: ENST00000583363
  CDS Start-End: 13-159
agtggaggaaagatggaggtgtggggacaggagctgggtgtgctggggactggccgcggacccctaacctgtgtctccggtctccctccggaagcggctcaacccagcccatcgctctggccccgttctggccctgcagggtggtggttgggacgttgaaatgagcgcgcgagtgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttaggtggtaaaatcaattgtttttgatggaattgattttccctgagtggagtgctgggggaaggaggaggtccaggccggtagtggccattcgccgtgcctcag

SEQ ID NO: 115949 - DNA, 567 bp, Homo sapiens
  Payload ID: 2624
  Gene Symbol: CDK5RAP3
  Gene Name: CDK5 regulatory subunit associated protein 3
  ENST ID: ENST00000578018
  CDS Start-End: 376-567
agcctgaagcggaagtggaggaaagatggaggtgtggggacaggagctgggtgtgctggggactggccgcggacccctaacctgtgtctccggtctccctccggaagcggctcaacccagcccatcgctctggccccgttctggccctgcagggtggtggttgggacgttgaaatgagcgcgcgagtggtacgtcctctctccgcgctcacgcccccctcctcaccgtgtttcccgccaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctactta

SEQ ID NO: 115950 - DNA, 901 bp, Homo sapiens
  Payload ID: 2624
  Gene Symbol: CDK5RAP3
  Gene Name: CDK5 regulatory subunit associated protein 3
  ENST ID: ENST00000583352
  CDS Start-End: 531-901
aggtgtggggacaggagctgggtgtgctggggactggccgcggacccctaacctgtgtctccggtctccctccggaagcggctcaacccagcccatcgctctggccccgttctggccctgcagggtggtggttgggacgttgaaatgagcgcgcgagtggtacgtcctctctccgcgctcacgcccccctcctcaccgtgtttcccgccaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctgtgagtgcttaggggctgtcactggagtcccctctttgctgaggtaacattcactactttcactgcctaagaatcctggaccttctcaaaggcacagaggcctccacgaagaatatttttggccgatactcttcacagcggatgaaggattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaaggacctgccgagtcagctggctgagattggggcagcggctcagcagtccctgggggaagccattgacgtgtaccaggcgtctgtggggtttgtgtgtga

SEQ ID NO: 115951 - DNA, 1768 bp, Homo sapiens
  Payload ID: 2624
  Gene Symbol: CDK5RAP3
  Gene Name: CDK5 regulatory subunit associated protein 3
  ENST ID: ENST00000580670
  CDS Start-End: 1-312
gaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggcaagattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaaggacctgccgagtcagctggctgagattggggcagcggctcagcagtccctgggggaagccattgacgtgtaccaggcgtctgtggggtttgtgtgtgagagccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcgattgactggggcgactttggggtagaggcagtgtctgaggggactgactctggcatctctgccgaggctgctggaatcgactggggcatcttcccggaatcagattcaaaggatcctggaggtgatgggatagactggggagacgatgctgttgctttgcagatcacagtgctggaagcaggaacccaggaaggtgttgccaggggcccagatgccctgacactgcttgaatacactgagacccggaatcagttccttgatgagctcatggagcttgagatcttcttagcccagagagcagtggagttgagtgaggaggcagatgtcctgtctgtgagccagttccagctggctccagccatcctgcagggccagaccaaagagaagatggttaccatggtgtcagtgctggaggatctgattggcaagcttaccagtcttcagctgcaacacctgtttatgatcctggcctcaccaaggtatgtggaccgagtgactgaattcctccagcaaaagctgaagcagtcccagctgctggctttgaagaaagagctgatggtgcagaagcagcaggaggcacttgaggagcaggcggctctggagcctaagctggacctgctactggagaagaccaaggagctgcagaagctgattgaagctgacatctccaagaggtacagcgggcgccctgtgaacctgatgggaacctctctgtgacaccctccgtgttcttgcctgcccatcttctccgcttttgggatgaagatgatagccagggctgttgttttggggcccttcaaggcaaaagaccaggctgactggaagatggaaagccacaggaaggaagcggcacctgatggtgatcttggcactctccatgttctctacaagaagctgtggtgattggccctgtggtctatcaggcgaaaaccacagattctccttctagttagtatagcggacttaataaaa

SEQ ID NO: 115952 - DNA, 1957 bp, Homo sapiens
  Payload ID: 2624
  Gene Symbol: CDK5RAP3
  Gene Name: CDK5 regulatory subunit associated protein 3
  ENST ID: ENST00000580391
  CDS Start-End: 342-518
tggggacaggagctgggtgtgctggggactggccgcggacccctaacctgtgtctccggtctccctccggaagcggctcaacccagcccatcgctctggccccgttctggccctgcagggtggtggttgggacgttgaaatgagcgcgcgagtggtacgtcctctctccgcgctcacgcccccctcctcaccgtgtttcccgccaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggcaagattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaaggacctgccgagtcagctggctgagattggggcagcggctcagcagtccctgggggaagccattgacgtgtaccaggcgtctgtggggtttgtgtgtgagagccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcgattgactggggcgactttggggtagaggcagtgtctgaggggactgactctggcatctctgccgaggctgctggaatcgactggggcatcttcccggaatcagattcaaaggatcctggaggtgatgggatagactggggagacgatgctgttgctttgcagatcacagtgctggaagcaggaacccaggctccagaaggtgttgccaggggcccagatgccctgacactgcttgaatacactgagacccggaatcagttccttgatgagctcatggagcttgagatcttcttagcccagagagcagtggagttgagtgaggaggcagatgtcctgtctgtgagccagttccagctggctccagccatcctgcagggccagaccaaagagaagatggttaccatggtgtcagtgctggaggatctgattggcaagcttaccagtcttcagctgcaacacctgtttatgatcctggcctcaccaaggtatgtggaccgagtgactgaattcctccagcaaaagctgaagcagtcccagctgctggctttgaagaaagagctgatggtgcagaagcagcaggaggcacttgaggagcaggcggctctggagcctaagctggacctgctactggagaagaccaaggagctgcagaagctgattgaagctgacatctccaagaggtacagcgggcgccctgtgaacctgatgggaacctctctgtgacaccctccgtgttcttgcctgcccatcttctccgcttttgggatgaagatgatagccagggctgttgttttggggcccttcaaggcaaaagaccaggctgactggaagatggaaagccacaggaaggaagcggcacctgatggtgatcttggcactctccatgttctctacaagaagctgtggtgattggccctgtggtctatcaggcgaaaaccacagattctccttctag

SEQ ID NO: 115953 - DNA, 867 bp, Homo sapiens
  Payload ID: 2624
  Gene Symbol: CDK5RAP3
  Gene Name: CDK5 regulatory subunit associated protein 3
  ENST ID: ENST00000579175
  CDS Start-End: 25-867
gcctgaagcggaagtggaggaaagatggaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaaggacctgccgagtcagctggctgagattggggcagcggctcagcagtccctgggggaagccattgacgtgtaccaggcgtctgtgggccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcgattgactggggcgactttggggtagaggcagtgtctgaggggactgactctggcatctct

SEQ ID NO: 115954 - DNA, 852 bp, Homo sapiens
  Payload ID: 2624
  Gene Symbol: CDK5RAP3
  Gene Name: CDK5 regulatory subunit associated protein 3
  ENST ID: ENST00000583697
  CDS Start-End: 1-818
gcgactttggggtagaggcagtgtctgaggggactgactctggcatctctgccgaggctgctggaatcgactggggcatcttcccggaatcagattcaaaggatcctggaggtgatgggatagactggggagacgatgctgttgctttgcagatcacagtgctggaagcaggaacccaggctccagaaggtgttgccaggggcccagatgccctgacactgcttgaatacactgagacccggaatcagttccttgatgagctcatggagcttgagatcttcttagcccagagagcagtggagttgagtgaggaggcagatgtcctgtctgtgagccagttccagctggctccagccatcctgcagggccagaccaaagagaagatggttaccatggtgtcagtgctggaggatctgattggcaagcttaccagtcttcagctgcaacacctgtttatgatcctggcctcaccaaggtatgtggaccgagtgactgaattcctccagcaaaagctgaagcagtcccagctgctggctttgaagaaagagctgatggtgcagaagcagcaggaggcacttgaggagcaggcggctctggagcctaagctggacctgctactggagaagaccaaggagctgcagaagctgattgaagctgacatctccaagaggcaaaagaccaggctgactggaagatggaaagccacaggaaggaagcggcacctgatggtgatcttggcactctccatgttctctacaagaagctgtggtgattggccctgtggtctatcaggcgaaaaccacagattctccttctagttagtatagcggacttaataaaagaggaaaaaac

SEQ ID NO: 115955 - DNA, 568 bp, Homo sapiens
  Payload ID: 2624
  Gene Symbol: CDK5RAP3
  Gene Name: CDK5 regulatory subunit associated protein 3
  ENST ID: ENST00000577664
  CDS Start-End: 26-358
agcctgaagcggaagtggaggaaagatggaggtgtggggacaggagctgggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgt

SEQ ID NO: 115956 - DNA, 738 bp, Homo sapiens
  Payload ID: 2624
  Gene Symbol: CDK5RAP3
  Gene Name: CDK5 regulatory subunit associated protein 3
  ENST ID: ENST00000579632
  CDS Start-End: 151-738
ctcccccagagcctctgcagtcagcagaggcaggttctctcccagagcctctggctttgggacagcctccctggagtcagtagctgggcagaactgttctcaaacatccttctgctccacgtgctcaaccatgtctattagagaaactgaatgaggaggcaaagcatgacaagtgccacaagagacctgcacactgctctggatggtaaagcgacgcaaggagggaagaaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacg

SEQ ID NO: 115957 - DNA, 2742 bp, Homo sapiens
  Payload ID: 2625
  Gene Symbol: CIZ1
  Gene Name: CDKN1A interacting zinc finger protein 1
  ENST ID: ENST00000277465
  CDS Start-End: 4-2616
accatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggc

SEQ ID NO: 115958 - DNA, 809 bp, Homo sapiens
  Payload ID: 2625
  Gene Symbol: CIZ1
  Gene Name: CDKN1A interacting zinc finger protein 1
  ENST ID: ENST00000324544
  CDS Start-End: 52-809
ggtctccgagcctccccttcgcgatgcggaggacgcgggacagaggccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtga

SEQ ID NO: 115959 - DNA, 2907 bp, Homo sapiens
  Payload ID: 2625
  Gene Symbol: CIZ1
  Gene Name: CDKN1A interacting zinc finger protein 1
  ENST ID: ENST00000357558
  CDS Start-End: 164-2776
cccgcccgcatttgggccttacgagcccacaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggctgtgc

SEQ ID NO: 115960 - DNA, 2984 bp, Homo sapiens
  Payload ID: 2625
  Gene Symbol: CIZ1
  Gene Name: CDKN1A interacting zinc finger protein 1
  Uniprot ID: Q9ULV3
  ENST ID: ENST00000372938
  CDS Start-End: 164-2860
cccgcccgcatttgggccttacgagcccacaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 115961 - DNA, 2858 bp, Homo sapiens
  Payload ID: 2625
  Gene Symbol: CIZ1
  Gene Name: CDKN1A interacting zinc finger protein 1
  Uniprot ID: Q9ULV3
  ENST ID: ENST00000372948
  CDS Start-End: 204-2732
aacacgattcctctggccaggccaaggggagggcgacactgacaggcgccccccacccaggggccgtggcgaagcaaggggccggctgctcagaaaaggataagaagtggtttctcctcccctcttcccttcctcatcctgcagcccgcgcctcccccctcgccgcgctgcgcacggatggcggcgggagccgcagagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggc

SEQ ID NO: 115962 - DNA, 2731 bp, Homo sapiens
  Payload ID: 2625
  Gene Symbol: CIZ1
  Gene Name: CDKN1A interacting zinc finger protein 1
  Uniprot ID: Q9ULV3
  ENST ID: ENST00000372954
  CDS Start-End: 143-2599
cgagcccacaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggctgtgca

SEQ ID NO: 115963 - DNA, 2645 bp, Homo sapiens
  Payload ID: 2625
  Gene Symbol: CIZ1
  Gene Name: CDKN1A interacting zinc finger protein 1
  ENST ID: ENST00000393608
  CDS Start-End: 1-2514
atgttcagccagcagcagcagcagcagctccagcaacagcagcaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggctgtgc

SEQ ID NO: 115964 - DNA, 2508 bp, Homo sapiens
  Payload ID: 2625
  Gene Symbol: CIZ1
  Gene Name: CDKN1A interacting zinc finger protein 1
  ENST ID: ENST00000415526
  CDS Start-End: 1-2463
ccgttgcccatggctgtcagccgggggctccccccgcagcagccacagcagccgcttctgaatctccagggcaccaactcagcctccctcctcaacggctccatgctgcagagagctttgcttttacagcagttgcaaggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgct

SEQ ID NO: 115965 - DNA, 684 bp, Homo sapiens
  Payload ID: 2625
  Gene Symbol: CIZ1
  Gene Name: CDKN1A interacting zinc finger protein 1
  ENST ID: ENST00000420484
  CDS Start-End: 179-684
gagggcgcgcggggaggcgaggtgcggggccgggggcggctgggtcgtggggctccgcctgcgagctggctgtgtctgcggaggaggcggctggcggggtgggagcgggcggagtggggcgcgaggaggtggcggtggtggagagaagccgtcccacggagctcaggaccacgccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccat

SEQ ID NO: 115966 - DNA, 2996 bp, Homo sapiens
  Payload ID: 2625
  Gene Symbol: CIZ1
  Gene Name: CDKN1A interacting zinc finger protein 1
  ENST ID: ENST00000538431
  CDS Start-End: 1-2865
atgtacatccgccaactgcgcgccccctctcaccgcagccccgcgcggggccccaggatcgcaggaccgcggcggccgcagggagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagccacccacaccacgaagagatgtgtttgcccacgttccagtgcaggggtggagcacagcccggcttgttacagatatgattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggctgtgc

SEQ ID NO: 115967 - DNA, 2855 bp, Homo sapiens
  Payload ID: 2625
  Gene Symbol: CIZ1
  Gene Name: CDKN1A interacting zinc finger protein 1
  Uniprot ID: Q9ULV3
  ENST ID: ENST00000629610
  CDS Start-End: 334-2727
cttacgagcccacaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggctg

SEQ ID NO: 115968 - DNA, 928 bp, Homo sapiens
  Payload ID: 2625
  Gene Symbol: CIZ1
  Gene Name: CDKN1A interacting zinc finger protein 1
  ENST ID: ENST00000471839
  CDS Start-End: 1-928
gttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagccacccacaccacgaagagatgtgtttgcccacgttccagtgcaggggtggagcacagcccggcttgttacagatatgattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaa

SEQ ID NO: 115969 - DNA, 3462 bp, Homo sapiens
  Payload ID: 2625
  Gene Symbol: CIZ1
  Gene Name: CDKN1A interacting zinc finger protein 1
  ENST ID: ENST00000634901
  CDS Start-End: 658-3354
tcgccgcgctgcgcacggatggcggcgggagccgcagaggtgtgtgtgtgctggcgggaggccgtgcccggtcctcgatgcccgcgggactacgtcctcttctagggactgggatgcgggggctgacctctgccacggcccaggaattcccatggggtttccttgtttctagaaggagaaagttggaacatgaattcaacaaatatttactaggtacctgctagaagccaggccctgtcctaggcactgaagattcagcaacgaataagacagccaaggcctctgccctcatagatcttgcatcaagctggggagacagacagtaaataaaaatgggattatactaagtatcctatactgctgtatcactgatgccaggccagcagcctggcatcacatggagttggttgaaaagaagaatctcagggccaggtgcagtggcccacacctgtaatcccagcactttaggaggccaaggcgggtggatcacttgaggccaggagttggagaccagcctgtccaacatggcgaaacaccatctctactaaatatacaaaaattagctgggcatggtagcccgcacctgtaatcccaggtatggatcagtggctactatgtgccagatctcagcaagacagaggaggatgaagagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaat

SEQ ID NO: 115970 - DNA, 2646 bp, Homo sapiens
  Payload ID: 2626
  Gene Symbol: CDKN2AIP
  Gene Name: CDKN2A interacting protein
  ENST ID: ENST00000302350
  CDS Start-End: 164-544
aagtgggcggttcggcggctctgggcgctgttgtttggtctttaggcctgcggaggggcgttatctggagggccgcgggtgcaggccgcagtgacagggccgctcgccccgctagtcctgcctgtctcccggtgcagctgtgttcgcggcctgcaggcccaacatggcgcaggaggtgtcggagtacctgagccagaacccgcgggtggcagcctgggtggaggcgctgcgctgcgacggcgagactgacaaacactggcgccaccgccgggattttttgcttcgcaacgccggggacctggcccccgctggcggcgctgcctccgctagcacggatgaagctgccgacgccgagagcgggacccgaaaccggcagctgcagcagctcatctccttttccatggcctgggcgaaccacgtcttcctcgggtgccgataccctcaaaaagttatggataaaatacttagtatggctgaaggcatcaaagtgacagatgctccaacctatacaacaagagatgaactggttgccaagaaggggtagaagagccatccaaaaaacgagttatagaaggaaaaaacagttctgcagttgagcaagatcacgcaaaaacctctgccaagacagaacgtgcatcagctcagcaggaaaacagttcaacgtgtatagggtcggccatcaaatcagagagtgggaactcagctcggagctctggcatctccagtcagaatagctctacaagtgatggagatcgatctgtttccagccaaagcagcagcagcgtttcctctcaggtaacaacggcaggatctgggaaagcttctgaagcagaagctccagataaacacggttctgcatcatttgtttccttgctgaaatccagtgtgaatagtcacatgacccaatccactgattctagacaacaaagtggatcacctaaaaagagtgctttggaaggctcttcagcctcagcttctcaaagcagctcagagatcgaggtgcccttgttgggctcctcaggaagctcagaggtagaattgccactattgtcttccaaacctagttcagagacagcttcaagtgggttaacttccaaaactagttcagaggcaagtgtttcatcatcagttgctaaaaacagttcctcatcaggcacatccttactgactcccaagagcagctcttcaacaaatacatcgctgctaacttccaagagcacttcccaggtagctgcatcactactagcttccaagagcagctcccagaccagtggatctctggtttccaaaagcacttccttagcaagtgtgtcccagttggcttctaagagtagttctcagactagcacctcacagttgccttctaaaagtacttcacagtcaagtgagagttctgtcaaattctcttgcaagttaaccaatgaagatgtgaaacagaagcaaccttttttcaatagactatataaaacggtggcatggaagttggtagctgttggtggctttagtcccaatgtgaatcatggagagctcctaaatgcagctattgaggctctgaaagcaacactggatgtattttttgtcccactaaaagaattggcagatctgcctcaaaataagagctctcaagaaagtattgtttgtgaattgaggtgcaagtctgtgtatttgggcactggctgtggaaaaagcaaagaaaatgcaaaagcagttgcatcaagagaagcattgaagttatttctcaagaaaaaggtggtggtaaaaatatgtaaaaggaaatacagaggcagtgaaatagaagatctagtactccttgatgaagaatcgaggcctgtaaacttacctccagcactaaaacatcctcaagaattactataatgtgtccaaaatatcactgcatacaatatctggtatttgaagagaaaaactgacttttgtatagtataaaacacaggctttcacaaattttgtattgctttttttccagttttgcagaaaatttacattctagttctcttcacacagtagcagttgtaaataatttatgaatgacagtacacattaaaaggtatgcattagcagcatattagtatgctgttttatttgctgaagaaaatactgtcttctatttttaatgatacattaggtacgatgtgtagttcggtagagtcctaaaatttttgtactactttcaatttggtgaaaatgtattaagttgtctaccatgttttcttttctagctgaataaaccacatcaaaggaaagggaccacagtatttgaatgtttgaaagtctgtaaagcttaaggttttaaaaatgttgcccgtaatgttgaacgtgtctgttaaaaaataaaagaaaaaatagttgcttcaaactatttttatgagaagttgtaagcattttttagatataaagcagtataaagtacttgttattttactctgaagttgtttaaaattcaccatgactttgaccgctgaagattctttaagcgggttaatttatgttttgaggtggaatacaatttacacttttttcttaaaaacatgaatgtgggtttctatattaagcatattttgtgactactattaacagattgatttgtttagatattaaatgctttaagctattttaccttttcaagaa

SEQ ID NO: 115971 - DNA, 860 bp, Homo sapiens
  Payload ID: 2626
  Gene Symbol: CDKN2AIP
  Gene Name: CDKN2A interacting protein
  ENST ID: ENST00000510928
  CDS Start-End: 102-509
atctggagggccgcgggtgcaggccgcagtgacagggccgctcgccccgctagtcctgcctgtctcccggtgcagctgtgttcgcggcctgcaggcccaacatggcgcaggaggtgtcggagtacctgagccagaacccgcgggtggcagcctgggtggaggcgctgcgctgcgacggcgagactgacaaacactggcgccaccgccgggattttttgcttcgcaacgccggggacctggcccccgctggcggcgctgcctccgctagcacggatgaagctgccgacgccgagagcgggacccgaaaccggcagctgcagcagctcatctccttttccatggcctgggcgaaccacgtcttcctcgggtgccgataccctcaaaaagttatggataaaatacttagtatggctgaaggcatcaaagtgacagatgctccaacctatacaacaagagatgaactggttgccaaggtgaagaaaagagggatatcgagtagcaatggttagcagatcatagatgtgaacatacataggagtttagagcataagtttgatataattaggaattattgttactaatttttttaacaagccagaatttttatgttattaataagtaataaagttggaatgttaaacctaaagtatatatctgtgtctttaggctttgaatttgatagtttgctttgactgctttagattttgaagtgtccactgttgtctgatgctgttatttttttaatattagacattcatgatgttattcaacactgttttaagaaattaatgactccacactttttaaagaaacgattagtcttgaaatgttttcactttgtgcctttattttaatgtgta

SEQ ID NO: 115972 - DNA, 2721 bp, Homo sapiens
  Payload ID: 2626
  Gene Symbol: CDKN2AIP
  Gene Name: CDKN2A interacting protein
  Uniprot ID: Q9NXV6
  ENST ID: ENST00000504169
  CDS Start-End: 208-1950
ggcggcggcgaggttataaaagggaagaagccggcggtgggcggaagtgggcggttcggcggctctgggcgctgttgtttggtctttaggcctgcggaggggcgttatctggagggccgcgggtgcaggccgcagtgacagggccgctcgccccgctagtcctgcctgtctcccggtgcagctgtgttcgcggcctgcaggcccaacatggcgcaggaggtgtcggagtacctgagccagaacccgcgggtggcagcctgggtggaggcgctgcgctgcgacggcgagactgacaaacactggcgccaccgccgggattttttgcttcgcaacgccggggacctggcccccgctggcggcgctgcctccgctagcacggatgaagctgccgacgccgagagcgggacccgaaaccggcagctgcagcagctcatctccttttccatggcctgggcgaaccacgtcttcctcgggtgccgataccctcaaaaagttatggataaaatacttagtatggctgaaggcatcaaagtgacagatgctccaacctatacaacaagagatgaactggttgccaaggtgaagaaaagagggatatcgagtagcaatgaaggggtagaagagccatccaaaaaacgagttatagaaggaaaaaacagttctgcagttgagcaagatcacgcaaaaacctctgccaagacagaacgtgcatcagctcagcaggaaaacagttcaacgtgtatagggtcggccatcaaatcagagagtgggaactcagctcggagctctggcatctccagtcagaatagctctacaagtgatggagatcgatctgtttccagccaaagcagcagcagcgtttcctctcaggtaacaacggcaggatctgggaaagcttctgaagcagaagctccagataaacacggttctgcatcatttgtttccttgctgaaatccagtgtgaatagtcacatgacccaatccactgattctagacaacaaagtggatcacctaaaaagagtgctttggaaggctcttcagcctcagcttctcaaagcagctcagagatcgaggtgcccttgttgggctcctcaggaagctcagaggtagaattgccactattgtcttccaaacctagttcagagacagcttcaagtgggttaacttccaaaactagttcagaggcaagtgtttcatcatcagttgctaaaaacagttcctcatcaggcacatccttactgactcccaagagcagctcttcaacaaatacatcgctgctaacttccaagagcacttcccaggtagctgcatcactactagcttccaagagcagctcccagaccagtggatctctggtttccaaaagcacttccttagcaagtgtgtcccagttggcttctaagagtagttctcagactagcacctcacagttgccttctaaaagtacttcacagtcaagtgagagttctgtcaaattctcttgcaagttaaccaatgaagatgtgaaacagaagcaaccttttttcaatagactatataaaacggtggcatggaagttggtagctgttggtggctttagtcccaatgtgaatcatggagagctcctaaatgcagctattgaggctctgaaagcaacactggatgtattttttgtcccactaaaagaattggcagatctgcctcaaaataagagctctcaagaaagtattgtttgtgaattgaggtgcaagtctgtgtatttgggcactggctgtggaaaaagcaaagaaaatgcaaaagcagttgcatcaagagaagcattgaagttatttctcaagaaaaaggtggtggtaaaaatatgtaaaaggaaatacagaggcagtgaaatagaagatctagtactccttgatgaagaatcgaggcctgtaaacttacctccagcactaaaacatcctcaagaattactataatgtgtccaaaatatcactgcatacaatatctggtatttgaagagaaaaactgacttttgtatagtataaaacacaggctttcacaaattttgtattgctttttttccagttttgcagaaaatttacattctagttctcttcacacagtagcagttgtaaataatttatgaatgacagtacacattaaaaggtatgcattagcagcatattagtatgctgttttatttgctgaagaaaatactgtcttctatttttaatgatacattaggtacgatgtgtagttcggtagagtcctaaaatttttgtactactttcaatttggtgaaaatgtattaagttgtctaccatgttttcttttctagctgaataaaccacatcaaaggaaagggaccacagtatttgaatgtttgaaagtctgtaaagcttaaggttttaaaaatgttgcccgtaatgttgaacgtgtctgttaaaaaataaaagaaaaaatagttgcttcaaactatttttatgagaagttgtaagcattttttagatataaagcagtataaagtacttgttattttactctgaagttgtttaaaattcaccatgactttgaccgctgaagattctttaagcgggttaatttatgttttgaggtggaatacaatttacacttttttcttaaaaacatgaatgtgggtttctatattaagcatattttgtgactactattaacagattgatttgtttagatattaaatgctttaagctattttaccttttcaagaa

SEQ ID NO: 115973 - DNA, 800 bp, Homo sapiens
  Payload ID: 2627
  Gene Symbol: CDKN2AIPNL
  Gene Name: CDKN2A interacting protein N-terminal like
  Uniprot ID: Q96HQ2
  ENST ID: ENST00000395009
  CDS Start-End: 28-285
atccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagcccacggggtcctaagtaggaaccagcttcacctctctgctttccctcttatgaaaatggccgatgcctttttgtgaaggtctcaaagcccacttcatcctggctgcagcaccaaaaggacaaaggcccgcttttgaagtgcctgataaggcattcctttcacccctccatgaggaaggtggcaaatcttgagactccctattagagagcttcgattttcctgaaattgtgttaggaaaatagggtgacttggtttgatcttggtttctatacctattatggctgcctgactctggtcatttggcccctgcaggcctaagccacttggttttgcttcacatattggggtttattagaacagtacgtagggaagcaatgccagaggcacccgtcccttttccctgccttctaggtgctcctgggaaatcctggttttccatggttaggcaaatgtcagagaattggggaaataaataatgtttttgttagactaacattccatgtatttaaaaaataaaaatattttggtcctca

SEQ ID NO: 115974 - DNA, 1223 bp, Homo sapiens
  Payload ID: 2627
  Gene Symbol: CDKN2AIPNL
  Gene Name: CDKN2A interacting protein N-terminal like
  Uniprot ID: Q96HQ2
  ENST ID: ENST00000458198
  CDS Start-End: 45-395
cgggaaggcggcgggctatccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagttacaataaagaccttttagacaaggtgatggaaatggccgatgggattgaagtggaagacctgccacaatttactaccagaagtgaattaatgaaaaagcatcaaagctaagccagaagatttatcacattttcatcatcagctacaggattagaaaggaggctgggatgaatgtgacatagaccacagcagctctcttaagactcctggtattaccaacataaagaggcaggtggaatgagaaggactctgtctagattggcttttttaacattctcattttcccaggagttatcactgtaaaagtatgcatggatatttatgtatttataaatcatgcactctaagatgagttcatcaacattgtaaaagccctcttttctgttttcaggtttttttttttcttatcgacaaggtctcactctgtcgcccaggcagaagcacaaaggtgcagtattggctcattgcagcctcgaactcctgggctcatattttcagggttttttgttttttgttttgtttttttgagacagagtcttgctctgttgcccaggcagtagtgcagtggcgcgatatattttcagtttttaaacgtcagaatttttgtttaaaatgcctttttgggctgggcacagtggcttatgcccataataatcccagcactttgggaggccgaggtgagcagatcacctgaggttaggagtttgagaccagcctggccaacacgatgaaaccccgtctctactaaaaatacaaacaaaattagctgggcatggtggcggacatctgtaatcccagctactcaggaggctgaagcagaagaactgcttgaacctgggaggtggaggttgcagtgagccaagatcgcaccattgcactccatcctgggcgacaaaaatgaaacaccgtctcaaaaaaaataaaaataataaaataaaa

SEQ ID NO: 115975 - DNA, 4461 bp, Homo sapiens
  Payload ID: 2628
  Gene Symbol: CDS1
  Gene Name: CDP-diacylglycerol synthase (phosphatidate cytidylyltransferase) 1
  Uniprot ID: Q92903
  ENST ID: ENST00000295887
  CDS Start-End: 424-1809
gcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttataaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccactgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaatcatatttt

SEQ ID NO: 115976 - DNA, 563 bp, Homo sapiens
  Payload ID: 2628
  Gene Symbol: CDS1
  Gene Name: CDP-diacylglycerol synthase (phosphatidate cytidylyltransferase) 1
  ENST ID: ENST00000511298
  CDS Start-End: 134-379
gttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttata

SEQ ID NO: 115977 - DNA, 945 bp, Homo sapiens
  Payload ID: 2629
  Gene Symbol: CDS2
  Gene Name: CDP-diacylglycerol synthase (phosphatidate cytidylyltransferase) 2
  Uniprot ID: O95674
  ENST ID: ENST00000450570
  CDS Start-End: 195-945
ccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagc

SEQ ID NO: 115978 - DNA, 9298 bp, Homo sapiens
  Payload ID: 2629
  Gene Symbol: CDS2
  Gene Name: CDP-diacylglycerol synthase (phosphatidate cytidylyltransferase) 2
  Uniprot ID: O95674
  ENST ID: ENST00000460006
  CDS Start-End: 308-1645
gaccgtgatggtggcgctgcgcgtgcgcactcgctccgagccctgctcccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataatgtgaccagtttaaatgtagtttgtattgtactgggggacctttcgttgttgttgtttgcttaaactgtgattttttttcccctccctaatttcaggggtgagattgactttgggaagacagattagttctttgtcaggccaacaagtgatggagtgcgggagagagaacttggcacccaaatatatcaaactattccgtgccgtggatgttttcattgccaacgagggtgtaatgatttgcttctgcaccttggtctagtgctggtttgtggtgtttttgtttgtaaattagcctcactgcctccctgaaagtgcacagtcagcccaggtctctagagtgtccagcagaggatggagccctcgggatgtttcagctcacacatccttgagtgacttcccatatgtgtgtggggctgaagcggcttctttccgctgaacttttatttccatttcagcctcgtggcttctcttattcaggtccaaggccccttaaaaacaaaacatattatcgcaagggctttcatttcagtattggctgtgtcactggcaggatgcatcactctccagggcctctttttcggagctactcccaattccactcttctgtgattctggctgagcaagttcatgccggtagaggctcattaagtgaggtcctgggcaccccccaaacaggaagtgttttcaggcccttacatgcttatccttaaggtgagtaggtatctcagcagcacacccgaacagtaaaggtgatcaataacgaaactgtagttttcagattgaagaatgaacctggatcaccaaactagataccgaaagggctcctcatttgtctcttttgtcccattgtgggcatatggtgggctccttgagaggagggagtctcagctggggcctggctgcagagacctgctcttgaatagggctgcctttgggatcagggagccgagcatactgggcaaggctcatcatgttcctttgtggaagtggttacttggtgggggtggggtggggaaggggggtctaggaagccgaagctgagtgcgcactagagctgctagcaggcaggccagagggtcagcttgtgttttattttctgatttctcctgcatgctttctggagatgaggattttttgtcaggtagctaggagagcactgccaccttgtgtccatatagcacaatgtttctctttcctattcacagacaagattcaagaaaccatttttacgtgtgtacattcaaatcttcatgaatggcatcacttgctttagacccattttttttttattggtcagaaataaaatgtgactgcaactgtgtgccctcccttgtcgtgaattccctgtttatcacttccatgcatggttttatgcttctcatttgtttatgtattcatgaatactgcatagtcctgattcagagacttttgctttgctttccaacttgtatccctacattctcacaacagccttcttacctcgggtgagagtcatgagcaccttaccaggcagggagcttccccaggatagtgtggtggagtcaggactcactccatcctgcactttacccacaggacacctggagggtcccccagccctgcttgcttttgtgaacgtcgtgtgagtacaccgaggtgttgcagctttccttccctctagctcaggaggcctggcctgagccaggttggagcttaaattgctgttggctcctgcctggtggaacaagggggtcatagaaaccagggctgatgggcaccccccagcccctgggagctctgctcatgaccgctcacagggtaccgagtctttgccttttgtgtgtgcgcatgctgccctcttaactgcttttagtattcagaaaggttccatttatgttttactcctgaaagtgaaaccctcttaggcaacttgtttcatattctgggcattttagtagctacagtattttgcatttaaaatgtaattactcttagtattgtacagccctataatgtatgagaactagtttcacatcctttgaaactaatctctttcattggggaggatacaacttttgactttacacaggtggactttgaatccatttttatagaatttttttccactgtaacttgacctatattatgcaagaaaatcccaaaaatatgttttaagggagactacacagaccttgtgatttggtctgagctagttgctgagttgactggagccttatttgaatggatctttgagttgagatcttcacactgtcagtgagcccttggctcagcccttgtcacctgtttgtatggggaccatgtttcccaaagctcaggttcatctccactattgacagagtcgggtagtgggagagtataagtgacttgagacagagtgtccttgctcagaaaactgtgaagcaggggtcttgttagttacaaagccagtcctagttgcatgtccaagggggtagattttcatcaccctactaaatgtggtatgtcactgctgaagccttttcctgttttagtaatatcttaggcactattgtcttttgtcttccagagtaacatatctgggcccacctttcttgcacactgtgattatgtgctaagaaaagggtggagttgggaggacaatttcacttgaacaggtttctgttcttctgaggtcagggtggggaggatgtccaggtgacttttatggacacattgcaagacagtaagccgcggatggactctcacttgtgctttggaacactggactccaaagagcaggtggaacaaactctggcctgaagatgatggctaatactcaggcagagccccgtattcttccctgacttggtcaaaacaaacttccttttcccttgatcaccctgcacgcagctgcccagcttccagtttttaaagagatgaacagctctcacttcctgactcagtttctcttgttgggtgggggccttgtgccacaacctgcatggggtgctagggtttaaaccaagtggtcacgaaggattcttatctcagggctctgcctggcccaccttctcttgggcctggactctccttatccacatccctgcagaaggtgggccctattctcagaagagtcctggctgctgttgccatctgaatgcgcccttccctttcaggttgaccagcagtggccttacctggcctctcaggtggatggaggctgttctcatctggggctgtctcttgattaaggctgtcacctgtttgtatagggaccatgtttcccaacgcactttgagtgcagtttaggaggtatcctttggatgctgaagtgttgggattttgaggacatgcggatgatttatgagaatagaggggcagagtttgtgaagtctagggttttttgtccagtgggtttcaaatttgttggctgtttaaagaccctgtctcctcccccaccctccccttccttttcccatcaaatgcctacctactgaggcgccttctctttttattcttgagccaatgagatatcagtgtgtttattaataaggattgcaatagtatagtgcttaatatgtgccaggcatagtgctaagggtttacatacgttatcccttttaatccagaaaacagcctttgattaggtattgttgtctccattttatagatgaggaaactgaggcagtatgactgaggccgagagcagtggttaagacagactttgggatcaaatcaccctaggtgcgggcaggtttctaggctgctctaagcttctaccttgaaggcagttgggtctgataatagtaccttcttcctggggtggttgtgaggatataacgaggtaatgcatgtaagcatttagtaccatgcctggcacatagtaagcactcaataaatggtagttacttttgttgagctcagctggtagtttgacctccgttggtgcaatgccagagatgggattgtcagccaccacactgccaccaccctgcacacagtctgggtccctccgagagaagcacgccaaccttaacatcccctacagcatcttggtgcttcacacaccatttaggaggccaccctaacgaggcaagaggacatgggggtgtgcagaagttctgttcttagtgagaatggctggcctgagaatccagctcacctcctctgcccacagtctggactgcttgtgggaaggccatctcctcctgtctggtggtacctccactctgggcagggagggcctgtctgtgactcgctctggaccccacttcccgctctggccaagggctgtcttctgtgcacatagctcaggagcctgcagcagttccctgtatgggtggatgtcctcaggggccaagaagagaagaatggggacaacagaaacctgctttgtaggggattatgtagactaaaagcctagaagttctgcccacatccttatgacgcagccaatctggagcttcatgtttccttctaaaagtagtaaccgggtagaagtgggtgacccattgaggacacatgatgtgaggtatttctgccggattctaggttagcaaagactcaaatgggtgactcatgaatgaagggagaacaggcacaggacttaatgaaaagagtttcttgaacttagttttctgaatgggggtggggagttggggcacgtgtgtgtaaggggaggctgcctcactttgaaggaatggtgttggctaacaggatccatgaaattcctaggtcagttgaataataactgaactactggtttgactgtggattatttcctgggtattagtgggacccaacagcacattgctattaatagtatggaaataatggtccctctgtttcattgaattgctgaagtaatgataatgccatgaaccaggagaagatggttgtgggggtttctaggaagcagctgctgtgacaggccaatcccaggcttgcccccgagccctcctgtccttctgggtttgtgtttgccttgcctggtgcttcctccctcattgtgttgttgaatagacctaggcagccttgtatccatagaaagcctccactgctgggccggggagggggttgtggtaagggccctctggaaatcaagcagagaatgcctttgcagtggtctcccgggcattgggcagggcctagccttttgcagcccccagaggaccttgcctgcataaagcactcagaagggttagccacctggtgattttgtctctagtgaaactgtgtttgccgataatcatccacatagccacctctgtcctcgcagtttggatgcctttttttgacacctgcgctaggttcttgtatgctggcttttcttaaaggaacagcagagtagaaaagaggttgagaatgttttctagcaggcagaatgtgcatacatgttttcatgagtgtcctttgggtgctgtttcttttaaatcctctgtgcacagggctctggcctttagtaaactgtttttctgtcttacgtcatgctgactgggtgctaggggctgattacaaaggggaagagttgaacagacatcaggggccgatgaaaccaaaggactaggagtcaggagaacaagtcagggattaggagacagcggtttggtttattgttatccagctggaggactcctaggggcagcagcaggaggaataccagggccacggaggggccaggagtctcacagtggagggcagactctaacagatgccagctgaacgctcgctggccctggatgtcatacgagttggggaccagaaatctgggctcagagaacccgtccagggagatttgaagccatgggttatcttctagagttgatactgataatatattttaatttttattgatgtttaataccttctgaaacaggagggtaagatcagatgggaagcccctctgttgaaggatcttgggaaccttggtggttttttttttttttttggttttttttttttgatcgagctgtggacatccttcttaattcgattctgaggatttgtttaactaaaaagttcccaaacacagaaagggcctccccacctgctttggggagctgtctgtgctgggagtgccaggcatcccatgggacccatcactgccagtgtctgtgcctcccagaggtcagccgtgtctgccctggctctgtctcctctgtgacagggcagagcatttctggtcagtttctccatggtgcctcccacccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaattcta

SEQ ID NO: 115979 - DNA, 2353 bp, Homo sapiens
  Payload ID: 2630
  Gene Symbol: CDIPT
  Gene Name: CDP-diacylglycerol--inositol 3-phosphatidyltransferase
  Uniprot ID: O14735
  ENST ID: ENST00000219789
  CDS Start-End: 880-1521
ccgtacccctccaggtgcctccttgagggcagtgaccccaagcgccagacgcttgagaagcttgggaggatgacgtagggtggagcctgcgacctaatcctcccatcacaaggggcacgcgaaaagcaacccatctgcagggcgctctggagcctctctagccgcctagagcctgcgagagcaaaggcggctggagacttagggggcggggagtaaagtgaggactgcaccaaatctcctggcctcttggggacgcaaagactcaggaggaggaattttatcgccttatctttgcctccaggaagtcataccctccacaaaaggaaagcagagatttttattcggtcttctcttttaccctttccttttccgtttctaactttgcttgacgttaatggttccttcctccctctcctcctctgcgctttggtacgagccaagggagaggggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 115980 - DNA, 1346 bp, Homo sapiens
  Payload ID: 2630
  Gene Symbol: CDIPT
  Gene Name: CDP-diacylglycerol--inositol 3-phosphatidyltransferase
  Uniprot ID: O14735
  ENST ID: ENST00000570016
  CDS Start-End: 244-885
aattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcgggggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcct

SEQ ID NO: 115981 - DNA, 1726 bp, Homo sapiens
  Payload ID: 2630
  Gene Symbol: CDIPT
  Gene Name: CDP-diacylglycerol--inositol 3-phosphatidyltransferase
  ENST ID: ENST00000561555
  CDS Start-End: 186-899
ctactgtgtgccctgcataagcagttggggttccagaaggcatgcttagagggaggatggagagggaagggtgatggcttctggagggttgactaattttttaatctgttctccagacccaactgtaaggcttcccctgaggcatcaagtctctatctagccctggagtcttggttctggggttgatgagttgcagacatagctttcctctcctcctaccctgttccctccactctcatgcctttctcagttcatgccatggtgacctttgcccactgacctcacacacagcctgttttctagcctgcgttcctccccaggcaggcggacacttccagtcttcgtttacaccctgcgtcagagtgataaaccaaatatgggcacctgtcctgcatccactgtgccataacagcccttgcccacctaatcttccaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtc

SEQ ID NO: 115982 - DNA, 1015 bp, Homo sapiens
  Payload ID: 2630
  Gene Symbol: CDIPT
  Gene Name: CDP-diacylglycerol--inositol 3-phosphatidyltransferase
  ENST ID: ENST00000564296
  CDS Start-End: 420-545
aaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcgcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctggg

SEQ ID NO: 115983 - DNA, 1532 bp, Homo sapiens
  Payload ID: 2630
  Gene Symbol: CDIPT
  Gene Name: CDP-diacylglycerol--inositol 3-phosphatidyltransferase
  Uniprot ID: O14735
  ENST ID: ENST00000569956
  CDS Start-End: 87-728
aattttgcaacgacgggcgcggaggaggaggttcccggaagccacgcgcagctggagcagcggcgaccgcagctggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagc

SEQ ID NO: 115984 - DNA, 1671 bp, Homo sapiens
  Payload ID: 2630
  Gene Symbol: CDIPT
  Gene Name: CDP-diacylglycerol--inositol 3-phosphatidyltransferase
  Uniprot ID: O14735
  ENST ID: ENST00000566113
  CDS Start-End: 348-854
attttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaata

SEQ ID NO: 115985 - DNA, 1047 bp, Homo sapiens
  Payload ID: 2630
  Gene Symbol: CDIPT
  Gene Name: CDP-diacylglycerol--inositol 3-phosphatidyltransferase
  ENST ID: ENST00000563415
  CDS Start-End: 34-507
gagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccc

SEQ ID NO: 115986 - DNA, 3307 bp, Homo sapiens
  Payload ID: 2631
  Gene Symbol: CDV3
  Gene Name: CDV3 homolog (mouse)
  Uniprot ID: Q9UKY7
  ENST ID: ENST00000264993
  CDS Start-End: 316-1092
ctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaaggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacactgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggttttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatgga

SEQ ID NO: 115987 - DNA, 955 bp, Homo sapiens
  Payload ID: 2631
  Gene Symbol: CDV3
  Gene Name: CDV3 homolog (mouse)
  Uniprot ID: Q9UKY7
  ENST ID: ENST00000431519
  CDS Start-End: 70-711
ccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaacaggtacttaaaatgaatgctacctggaattaaatgactacatatggcacatctacatcttactttagggacatgaattttttaaaataaataaaatgggaagaaatgtaaatgacatcagatggaaatgtgttttttggggtggcttttagaataaatcccagccttttcaccactttgagagcacagctggcttgaatttaaacctccacgtggacttgctcctctgctctgtcttaaaaaatgtgtaagggaccttg

SEQ ID NO: 115988 - DNA, 3621 bp, Homo sapiens
  Payload ID: 2631
  Gene Symbol: CDV3
  Gene Name: CDV3 homolog (mouse)
  Uniprot ID: Q9UKY7
  ENST ID: ENST00000420115
  CDS Start-End: 203-535
accccttccgatatccgcggtggagccgcccttcccaccccgcgtcgctcggcgttagccaaggcccgggcggcgccaccctccgggggcactaggtctggggccgcagtgcccagcacagagcagcgtttatcgggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaagtacttaaaatgaatgctacctggaattaaatgactacatatggcacatctacatcttactttagggacatgaattttttaaaataaataaaatgggaagaaatgtaaatgacatcagatggaaatgtgttttttggggtggcttttagaataaatcccagccttttcaccactttgagagcacagctggcttgaatttaaacctccacgtggacttgctcctctgctctgtcttaaaaaatgtgtaagggaccttgggagggcagtgattcaccacactcgagtttctttacctgatctaatcagatccactcccacaaaatcgatgtgaggagaaatcattgactaatgagtagaatttacttgaatgagaaaattgttacccttgtgcataaagagagagatgtattatctattacttgctaaaagtaagagtcttaggaggaatgtcattacacagcttttaacagttttcttcaagtttgtcctgaaatagggtcacagttaatactgttcagtagaagataggaccctagagcttcaatacagcgttctgtgttttctgtttgaattgaagccttaaaatggtttgataaggattttctatatgcctccactcctacccctccccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacactgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggttttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatgg

SEQ ID NO: 115989 - DNA, 563 bp, Homo sapiens
  Payload ID: 2631
  Gene Symbol: CDV3
  Gene Name: CDV3 homolog (mouse)
  ENST ID: ENST00000503932
  CDS Start-End: 1-563
ctttgccaagagggacaagaagaagaagaaggagcggagcaaccgggcggcgagtgccgcgggcgcagcgggcagcgccggcggaagcagtggagccgcgggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaaggataaagaaatggagaagagctttgaagtagtaagacacaaaaatagaggtagggatgaggtttcaaaaaaccag

SEQ ID NO: 115990 - DNA, 1305 bp, Homo sapiens
  Payload ID: 2631
  Gene Symbol: CDV3
  Gene Name: CDV3 homolog (mouse)
  ENST ID: ENST00000515421
  CDS Start-End: 176-502
gaattttcgctttcagcagccgcatttgtagcagctcttttgtgatgacttagtctctaagcccgtgaaagaaaaagaaaactctcggtggcaaggttgaagtagaaatgacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaaatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacactgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggttttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatg

SEQ ID NO: 115991 - DNA, 661 bp, Homo sapiens
  Payload ID: 2631
  Gene Symbol: CDV3
  Gene Name: CDV3 homolog (mouse)
  ENST ID: ENST00000508481
  CDS Start-End: 185-655
gggctgggctcgccagggccgggaccccttccgatatccgcggtggagccgcccttcccaccccgcgtcgctcggcgttagccaaggcccgggcggcgccaccctccgggggcactaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaaggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatg

SEQ ID NO: 115992 - DNA, 471 bp, Homo sapiens
  Payload ID: 2631
  Gene Symbol: CDV3
  Gene Name: CDV3 homolog (mouse)
  ENST ID: ENST00000504867
  CDS Start-End: 312-471
gcgtcgctcggcgttagccaaggcccgggcggcgccaccctccgggggcactaggtctggggccgcagtgcccagcacagagcagcgtttatcgggtgacgtctaggctgagtaattccgtgtgctgacctcagcccagtagtttgagctgaattttcgctttcagcagccgcatttgtagcagctcttttgtgatgacttagtctctaagcccgtgaaagaaaaagaaaactctcggtggcaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattg

SEQ ID NO: 115993 - DNA, 448 bp, Homo sapiens
  Payload ID: 2631
  Gene Symbol: CDV3
  Gene Name: CDV3 homolog (mouse)
  ENST ID: ENST00000507408
  CDS Start-End: 172-448
agtttgagctgaattttcgctttcagcagccgcatttgtagcagctcttttgtgatgacttagtctctaagcccgtgaaagaaaaagaaaactctcggtggcaaggacgaagatgaatggaaagaattggagcaaaaagaggttgattacagcggcctcagggttcaggcaatgcaaataagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcc

SEQ ID NO: 115994 - DNA, 554 bp, Homo sapiens
  Payload ID: 2631
  Gene Symbol: CDV3
  Gene Name: CDV3 homolog (mouse)
  ENST ID: ENST00000511392
  CDS Start-End: 186-512
agtttgagctgaattttcgctttcagcagccgcatttgtagcagctcttttgtgatgacttagtctctaagcccgtgaaagaaaaagaaaactctcggtggcaaggttgaagtagaaatgacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaagtacttaaaatgaatgctacctggaattaaatgactacatatggcacatctacat

SEQ ID NO: 115995 - DNA, 568 bp, Homo sapiens
  Payload ID: 2632
  Gene Symbol: CEBPZOS
  Gene Name: CEBPZ opposite strand
  Uniprot ID: A8MTT3
  ENST ID: ENST00000397064
  CDS Start-End: 35-277
gcgcatgcgcagtcccccttgaacgcacctcaggatggcccgtactttggaaccactagcaaagaagatctttaaaggagttttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatgatttcactctgtcacccaggctagagtgcagtgccgtaatcttggctcacggcaacctctgactcctggattcaagcgattctcgtgcctctgcttctcgagtagctgggactacaggtgcgtgccaccatgcccagctcattttttggggtttttagtagagacagggtttcaccatattggccaggctggtctcgaactcctgacctcaaacaatcttcctgcctcggcctgccaaagtgctgggattacaggtgtgagccacagcgcctggccccaaatatttct

SEQ ID NO: 115996 - DNA, 1499 bp, Homo sapiens
  Payload ID: 2632
  Gene Symbol: CEBPZOS
  Gene Name: CEBPZ opposite strand
  Uniprot ID: A8MTT3
  ENST ID: ENST00000397226
  CDS Start-End: 425-667
aagactctggcgagtggcttcccatgggcggtcggatttcggggtccctagtgcgacgagagtggggcggtcttctgcgtggggcctcgtcacagttctgggggcatgtggaggatagtcaggtgtcactgccttaattcactggaggtgtatccctggtggtctgtagcaaaggaacttgaagttttatcagcctcctgaagccgagagcctcagtgcaaaacgtatatgtatttttaaaaaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagttttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccaggcatggtggctcacaccagtaatctcagcactttgggaggccgaggcaggcgggtcacttgaggtcaggagttcgagaccagcctggccaacatggtgaaaccctgtttctactaaaaatacaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgtctcaaaaaaaaaaaaaaaaaaaaaaaaaaaaaaaaaaaaaaaaaaaaaaaa

SEQ ID NO: 115997 - DNA, 695 bp, Homo sapiens
  Payload ID: 2632
  Gene Symbol: CEBPZOS
  Gene Name: CEBPZ opposite strand
  Uniprot ID: A8MTT3
  ENST ID: ENST00000392061
  CDS Start-End: 15-257
gaacgcacctcaggatggcccgtactttggaaccactagcaaagaagatctttaaaggagttttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttgatctcttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaa

SEQ ID NO: 115998 - DNA, 3158 bp, Homo sapiens
  Payload ID: 2632
  Gene Symbol: CEBPZOS
  Gene Name: CEBPZ opposite strand
  Uniprot ID: A8MTT3
  ENST ID: ENST00000402297
  CDS Start-End: 35-277
gcgcatgcgcagtcccccttgaacgcacctcaggatggcccgtactttggaaccactagcaaagaagatctttaaaggagttttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccaggcatggtggctcacaccagtaatctcagcactttgggaggccgaggcaggcgggtcacttgaggtcaggagttcgagaccagcctggccaacatggtgaaaccctgtttctactaaaaatacaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgtctcaaaaaaaaaaaaaaaaaaaaaaaaaaaaaaaaaaaaaaaaaaaaaaaagaataaataaaataacgaaaatttcctatcttctgaagttccaagccaaagctatttttaaaacatcaataaaaaaatttaagttacttacttgcattatctttgttagccatggcattcatgccaatgttatcaaacttggatcccatattttcatccaatagatggccaaacttttaaacaaaaacgataaatttattagaaaactaaaaataatgtagaatagctagcttgttaaaacagtacattagccttacctcttcagcagatacaaataggctggaatcatttaagtttcttttcttttttcttggccctaaaaaaaattgtaagtctacattattcaattataaatctaatgattttagaaaaatgcaatgcaacatgattttattttaaaaattatacttgggtaaaaacaattgcaataatcttctggcaccattgggtagctggcatttaaatataatttaagagttagtatataatattttcaaaaagctaacaacatcctaatagaactgttcagatgacaagagtgtcttcttgcttttcagatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactaaatacagatcataacattcagctgttttaagtgtattaacgcattttggtaaatttacagacttgttcaaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgatttttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttgatctcttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 115999 - DNA, 687 bp, Homo sapiens
  Payload ID: 2632
  Gene Symbol: CEBPZOS
  Gene Name: CEBPZ opposite strand
  Uniprot ID: A8MTT3
  ENST ID: ENST00000406711
  CDS Start-End: 197-439
cttgaacgcacctcaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagttttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatat

SEQ ID NO: 116000 - DNA, 4186 bp, Homo sapiens
  Payload ID: 2633
  Gene Symbol: CDON
  Gene Name: cell adhesion associated, oncogene regulated
  Uniprot ID: Q4KMG0
  ENST ID: ENST00000263577
  CDS Start-End: 129-3923
gtctctccaagggaatgaaaggtgaggggagcgtgagtgcaggcatgatgggaatctccgtgacttgtgaaccaaggactgggttttgctctggaagcctgtcctgattgcttctgtaatctggcgctatgcatccggatcttggacccttatgtacactgctgtatgttactcttacaattctgtgctcttctgtgagttcagacttggcaccttattttacttctgagccgctctctgctgtccagaaacttggtggacctgtagtactgcattgttctgctcaacctgtgaccactcgtatctcatggctgcataacggaaaaacattggatggaaacctggaacatgttaagattcatcaggggactctgacaattctttctctcaactcctctcttttgggttactaccagtgccttgccaacaatagcatcggtgccattgtgagtggccctgcgacagtatctgtggcagttcttggtgattttggttcatccacaaagcatgttattacagcagaagaaaaaagtgctggtttcattggctgcagggtaccggagagtaaccccaaagctgaggtgcgctataaaatccggggaaaatggctggaacattccacagagaattacttaatccttccatcaggaaatcttcagattttgaatgtatccttagaggacaagggatcatacaaatgtgcagcttataatcctgtcacacatcaattaaaagttgaacctattggccgaaagctccttgtgagtcgtccttcttcagatgatgttcacattcttcaccccacccattcacaggcattagctgttctttctcgtagccctgtaaccttggagtgtgtggtgagtggggtcccggctcctcaagtgtattggctaaaggacgggcaggacattgcaccaggaagcaactggagaaggttgtattctcatcttgccactgatagcgttgacccggcggactccggaaactattcctgcatggcgggaaacaagtctggagatgtaaaatatgtgacttacatggttaatgtacttgaacatgcttccatttctaaaggactacaggatcagatagtgtctctgggtgccacagtacactttacctgcgacgttcatgggaacccagcccccaactgtacctggtttcacaatgcacagcctattcatccttctgcacgacatctaactgcaggaaacggactgaaaatcagtggggttactgtggaagatgttgggatgtatcagtgtgtagcagataatgggattggatttatgcactctactggaagacttgaaattgaaaatgacggtggattcaagccagttataattacggcaccagtaagtgcaaaggttgcagacggagactttgttactctgtcctgcaatgccagtgggctgccggttccggtcattcgttggtatgacagccatggattgataaccagccatccatctcaagtcctgagatcgaaatcccgaaaatcacagttatcaagacctgagggcttgaacctggagcctgtgtacttcgtcctgtcccaagctggtgcaagctctctccatattcaggctgtgactcaggaacatgcggggaaatacatctgcgaagctgcaaatgaacatggtaccacacaggcagaagcatctctcatggttgttccttttgaaacaaatacaaaagcagagacagtcacacttcctgatgctgctcagaatgatgacagaagtaagagagatggttcagaaactgggttactgagctcatttccggtgaaggtccatcccagtgcagtggaatcagcaccagagaaaaacgccagcggcatctctgttcctgatgcccccatcatactgagccccccacagacccacacaccagacacgtacaacctggtgtggagggcaggcaaggatggtgggctgcccatcaatgcttactttgtgaagtatcgaaagctggatgatggggttggcatgctgggaagctggcacacggttcgagtcccaggaagtgaaaatgagctccatttagctgagctggagccatctagtctttatgaagtcttgatggtagcaagaagcgcagcaggtgaaggccaacctgccatgcttaccttccgaaccagcaaagaaaaaacagcgtcatcaaaaaacacccaggcatcctctccacccgtgggcatccctaagtatcccgttgtttcagaggctgcaaacaacaattttggagtggtacttacagattcctctaggcacagtggagttccagaggcaccagatcggcctaccatctccactgcatcagagacatcagtctatgtcacttggattcctcgggcaaacgggggttctccaatcactgccttcaaagtcgaatataaacggatgaggaccagcaattggctggtggcagctgaagacatccctccttccaaactttcagtggaagttcgtagtttagaaccaggttcaacatacaaatttagggtcattgccatcaaccattatggtgagagttttcggagttcagcatctcgtccttatcaagtggttgggttccccaatcgcttttccagccgtccaataactggacctcacattgcatacacagaggctgtcagcgatactcagatcatgctaaagtggacgtacattccatcaagtaacaataacactcccattcaaggattttatatctattaccgaccaacagatagtgacaatgacagtgattacaagagggatgttgtagaaggttcaaagcagtggcacatgattggccacctgcagccagaaacctcctatgacattaaaatgcaatgcttcaatgaaggaggagaaagtgaatttagcaatgtgatgatctgcgagactaaagtgaaacgtgttcctggagcttctgaatatcctgtcaaagacttgagtacccctccaaattctttgggaagtggaggaaatgtggggcctgcaaccagccctgccagaagcagtgacatgttatatctgatcgttggctgtgtgctgggcgtcatggtcctcattctgatggttttcattgcaatgtgcctgtggaagaatcgccagcagaataccatacaaaaatatgacccaccaggatatctctaccaaggatcagatatgaacgggcagatggtggactacaccactctctcaggagcaagtcagataaatggaaatgttcacggaggcttcctaaccaatggcggtctcagcagtggctattcccaccttcaccataaggtccccaatgcagtcaatggaattgtgaatgggagcctaaatggagggctttactccgggcacagcaactctctaaccaggacacacgtggattttgaacatcctcatcatctagtgaatggtggtggaatgtacacggccgtgcctcagattgaccctctggagtgtgttaactgccgaaattgtcgaaacaacaataggtgtttcaccaaaaccaacagcactttcagcagcagccctcctcctgtggtccctgtggtagcaccttatcctcaggatggtttggaaatgaagcccctcagtcacgtgaaggtgcctgtatgcctgacttccgcagtccctgattgtggccagttgccggaggagagcgtcaaggacaatgtggaaccagtccctactcagcgtacctgctgtcaggacattgtaaatgacgtcagctctgatggctcagaagatccagcagagttcagcagaggagacagctgtgcccattcagaaacagagatcaacattgtaagttggaatgctcttattttgccacctgtccccgagggctgtgctgagaagacaatgtggtctccacctggcattcctttagacagcccgacagaggtccttcagcagccccgggaaacctgaggacatgcaaacaaccagtcatgttccaacttcaagccggtaactgcacacaacaggcctgggagcgaactgtgtgaaggaccttaattcaaatcagagaaaatcattatttatttttttgtagtagtaatgtcatatgaatgtatcttaaaacgtgtgcccttttatattatttatgccttaaatgttttcttccccattccttcctccccctcggtaggaaacaaccttgttttgcatagtattcagtcacctggagggca

SEQ ID NO: 116001 - DNA, 9138 bp, Homo sapiens
  Payload ID: 2633
  Gene Symbol: CDON
  Gene Name: cell adhesion associated, oncogene regulated
  Uniprot ID: Q4KMG0
  ENST ID: ENST00000392693
  CDS Start-End: 129-3992
gtctctccaagggaatgaaaggtgaggggagcgtgagtgcaggcatgatgggaatctccgtgacttgtgaaccaaggactgggttttgctctggaagcctgtcctgattgcttctgtaatctggcgctatgcatccggatcttggacccttatgtacactgctgtatgttactcttacaattctgtgctcttctgtgagttcagacttggcaccttattttacttctgagccgctctctgctgtccagaaacttggtggacctgtagtactgcattgttctgctcaacctgtgaccactcgtatctcatggctgcataacggaaaaacattggatggaaacctggaacatgttaagattcatcaggggactctgacaattctttctctcaactcctctcttttgggttactaccagtgccttgccaacaatagcatcggtgccattgtgagtggccctgcgacagtatctgtggcagttcttggtgattttggttcatccacaaagcatgttattacagcagaagaaaaaagtgctggtttcattggctgcagggtaccggagagtaaccccaaagctgaggtgcgctataaaatccggggaaaatggctggaacattccacagagaattacttaatccttccatcaggaaatcttcagattttgaatgtatccttagaggacaagggatcatacaaatgtgcagcttataatcctgtcacacatcaattaaaagttgaacctattggccgaaagctccttgtgagtcgtccttcttcagatgatgttcacattcttcaccccacccattcacaggcattagctgttctttctcgtagccctgtaaccttggagtgtgtggtgagtggggtcccggctcctcaagtgtattggctaaaggacgggcaggacattgcaccaggaagcaactggagaaggttgtattctcatcttgccactgatagcgttgacccggcggactccggaaactattcctgcatggcgggaaacaagtctggagatgtaaaatatgtgacttacatggttaatgtacttgaacatgcttccatttctaaaggactacaggatcagatagtgtctctgggtgccacagtacactttacctgcgacgttcatgggaacccagcccccaactgtacctggtttcacaatgcacagcctattcatccttctgcacgacatctaactgcaggaaacggactgaaaatcagtggggttactgtggaagatgttgggatgtatcagtgtgtagcagataatgggattggatttatgcactctactggaagacttgaaattgaaaatgacggtggattcaagccagttataattacggcaccagtaagtgcaaaggttgcagacggagactttgttactctgtcctgcaatgccagtgggctgccggttccggtcattcgttggtatgacagccatggattgataaccagccatccatctcaagtcctgagatcgaaatcccgaaaatcacagttatcaagacctgagggcttgaacctggagcctgtgtacttcgtcctgtcccaagctggtgcaagctctctccatattcaggctgtgactcaggaacatgcggggaaatacatctgcgaagctgcaaatgaacatggtaccacacaggcagaagcatctctcatggttgttccttttgaaacaaatacaaaagcagagacagtcacacttcctgatgctgctcagaatgatgacagaagtaagagagatggttcagaaactgggttactgagctcatttccggtgaaggtccatcccagtgcagtggaatcagcaccagagaaaaacgccagcggcatctctgttcctgatgcccccatcatactgagccccccacagacccacacaccagacacgtacaacctggtgtggagggcaggcaaggatggtgggctgcccatcaatgcttactttgtgaagtatcgaaagctggatgatggggttggcatgctgggaagctggcacacggttcgagtcccaggaagtgaaaatgagctccatttagctgagctggagccatctagtctttatgaagtcttgatggtagcaagaagcgcagcaggtgaaggccaacctgccatgcttaccttccgaaccagcaaagaaaaaacagcgtcatcaaaaaacacccaggcatcctctccacccgtgggcatccctaagtatcccgttgtttcagaggctgcaaacaacaattttggagtggtacttacagattcctctaggcacagtggagttccagaggcaccagatcggcctaccatctccactgcatcagagacatcagtctatgtcacttggattcctcgggcaaacgggggttctccaatcactgccttcaaagtcgaatataaacggatgaggaccagcaattggctggtggcagctgaagacatccctccttccaaactttcagtggaagttcgtagtttagaaccaggttcaacatacaaatttagggtcattgccatcaaccattatggtgagagttttcggagttcagcatctcgtccttatcaagtggttgggttccccaatcgcttttccagccgtccaataactggacctcacattgcatacacagaggctgtcagcgatactcagatcatgctaaagtggacgtacattccatcaagtaacaataacactcccattcaaggattttatatctattaccgaccaacagatagtgacaatgacagtgattacaagagggatgttgtagaaggttcaaagcagtggcacatgattggccacctgcagccagaaacctcctatgacattaaaatgcaatgcttcaatgaaggaggagaaagtgaatttagcaatgtgatgatctgcgagactaaagtgaaacgtgttcctggagcttctgaatatcctgtcaaagacttgagtacccctccaaattctttgggaagtggaggaaatgtggggcctgcaaccagccctgccagaagcagtgacatgttatatctgatcgttggctgtgtgctgggcgtcatggtcctcattctgatggttttcattgcaatgtgcctgtggaagaatcgccagcagaataccatacaaaaatatgacccaccaggatatctctaccaaggatcagatatgaacgggcagatggtggactacaccactctctcaggagcaagtcagataaatggaaatgttcacggaggcttcctaaccaatggcggtctcagcagtggctattcccaccttcaccataaggtccccaatgcagtcaatggaattgtgaatgggagcctaaatggagggctttactccgggcacagcaactctctaaccaggacacacgtggattttgaacatcctcatcatctagtgaatggtggtggaatgtacacggccgtgcctcagattgaccctctggagtgtgttaactgccgaaattgtcgaaacaacaataggtgtttcaccaaaaccaacagcactttcagcagcagccctcctcctgtggtccctgtggtagcaccttatcctcaggatggtttggaaatgaagcccctcagtcacgtgaaggtgcctgtatgcctgacttccgcagtccctgattgtggccagttgccggaggagagcgtcaaggacaatgtggaaccagtccctactcagcgtacctgctgtcaggacattgtaaatgacgtcagctctgatggctcagaagatccagcagagttcagcagaggtcaggaaggcatgatcaaccttaggattccagatcatcttcagttagctaagagctgtgtatgggaaggagacagctgtgcccattcagaaacagagatcaacattgtaagttggaatgctcttattttgccacctgtccccgagggctgtgctgagaagacaatgtggtctccacctggcattcctttagacagcccgacagaggtccttcagcagccccgggaaacctgaggacatgcaaacaaccagtcatgttccaacttcaagccggtaactgcacacaacaggcctgggagcgaactgtgtgaaggaccttaattcaaatcagagaaaatcattatttatttttttgtagtagtaatgtcatatgaatgtatcttaaaacgtgtgcccttttatattatttatgccttaaatgttttcttccccattccttcctccccctcggtaggaaacaaccttgttttgcatagtattcagtcacctggagggcagaggggtccttccatgttttctaacagctatagtgacagcaagagctcctcatgcaaaggatcccatctcttggctgcttcggctaggagggaatgcaggggcccgttgaaggttgccaccagctgggttttcaggtggaaaatggtctttcaatagtgtattctcagacttttttttgtttgttttttgagatggagtcttgctgtcatccaggctggagtgcaatggctcgatcttggctcactgcaacctccgcctcccaggttcaagcaattctcccgcctcagcctcctgagtagctgggactacaggcacctgccaccacgtccagctaattgtcttgtatttttattagagacaaggtttcaggctggttttgaactcctgacctcaagtgatccacccgcctccgcctcccaaagtgcgaggattacaggcgtgagccaccacgtctggcctgtattatcagacttcctgagaacactttgaaatcaactgcagttgtgacccatgtttataataacagacctggctgacggattttacaagagtgccttccacagaagtggtaatgtgacctgttgactttgtatctgcacgtgggcacgagtgatgttcagtttgctaggcactagtcatagtgttatggacgtggtggagtgtaaggtcttgatgaattacggcagtatgcagaaaaggaaccaaggccagagagacaaataatgcctcatgtcccactgctttaaaattacattaatttataaaatggccactatgggctctttttgactgtttctcggagtaggaacaaaataagacattaaatggtggcttgaagagaaagatacacattttcagaagaaagaaaggggagggctgcagggagcctgtcttggcgggagctctccagtctgttggattagcacagggacacgcttatggtgccatgacgccgaaactagtcatcccccatctccagcataggcaacggcctgcaggggtgagtgtcagaaaagacttactttggaagaaaagggtttttttttgtttgtttgttttttgtttttttttgtttgtttgttttgggtttttttcctgaaatttcctgatacctttttcagaatgtcacccttgtaaataggcacctaaagccaagttggtcagcagagctcctgaccacggctgcctctgcgtgacaaggacatttgcagctgcctttggaaggctcttcacattaaaaaacaataattatgtaagtgtgtttcatagcttgagtcaagctttcaaggatcactgctcctttgtgcattgtgcatccctttggggaaagaaacagaaaattattctctttctatagagtcaagcaattccagcagaagtgaagaaatgttagtttcccagaaatcgcagtggaatagaatacaatactgtgttaaccaactttctgtataaatgcatcagtattcccttacatatgtctatatattttataatagaactgttagtgaaaatgtgcttgtttaagctgggtcactatgcaagagttacttccagtagaatgtagtgaatgtaattccctagtcggatattagggatgctgtagacccaagttctacattccagatgtccgtgcctatagtatactggatttattcttcatgttgcttaaatgcagttagctctggagggggatagctgcatcccttacttctgtgactagcaaaggacaaagtcccagcgcacagaatatgaaaacataccctgtgttagccaatcaagttacagcaatgctgtcacaaagggagttttagaaaactggggagtcattgtccgtagacagccattttgatttaggaaacaggtgtattagcatgagccttaggtcatgaactgcttttaaagattgagtttgaatatgggatctgtccacgaggaagagaaaatggctttacctttaggacaatctcattgtggactgctttatttatattattagtaacgctgttttaagtgttattctttttattgtattttatttataaaaaatgcctttatatattgaaatatataaatatatatatataaacacacacacacacacacacacacacatatatatatatatatataattgcctttatatttaggcggtatgagttctccctaagcgtgagttggctctgccctgcacaggcacccaaacagtcctacctaatgtcacttcaccaggaaatgagaggacatggtacagtgtgggagacagcactaacacgtgctgaataactactgtgtaccaggcactgtgctcggtgcttgttactgttaactcatttaacccccacaactcatctacaaagttggcattaaaatccccaagtcactcagtgagccatgggacctgaatccgaacctagtttatctggagccataatctgggctcctcccatttttccatactgctttccaaaagcattgtggttcactctttggatggaaccagtcccgttccgtatgctgtgatctatccctgccgtggaattcctccgaggctccaactccgcagccagagaagctgctctctggcctccgcgggcagagctctgcttatgacttcgtcttccagaggtccacatttctccccttgacgccccctgtctaccacctccacctggaaatttgatctttactgtgctcagtgatcacgaaattggtcaagcctattcatgttccttctcatctagaattctgtgtgattgttttagcataaactgccccgctcccactgtatcatttcacgatctccttttaatgtttttctttcagttttgcactgacagtctggtgacaggtgctgccagggtgcaagttacattgcaatgttctaaaccttttgaagtgttcttagcaaaagcctttctttctgggtgtttttgtcgaatgagtctatgaagactcaatgcatccatcttgggctgatcatgccacagatctcattccagctatagtactgccaagaagtgaagtttatcattgaattttacctgtgttgctctcttttaaagtaatgactttgagatgcatgctttgtatcatattgaaaagtatgttttattttccttaaagttgtaatattgtgtgtgaaactgtacatattttaaatgatgtagctttggcaggttttatttggttgatatgattttatattaaaagagaaggctgctttcatatagcatagcccctgaaggtgggaatactccctgtttgtacaacgctgcttatagtttgtgattggggtgggcgaatgtcttcctctgaaattctttggaaccccccacccctgtcctcccctgaaactcccctgtgcacacccctctgttctgactgcagagatcaaggccctgaaggagcaggatcttgggcaagtgttttaggggacgctgagaacatacctgaccctgggggcgatgtggaggcaggcccacctcctcggggcaactttgcgtttccttggagggaagggaggtgggtaggagaggagcttgggaggatgaggaggagcggtcccgcctcacacattgtctatttttaccattaaccgagcgccacatgtttatgaacttcaggatagaaatttagcctccttgtgaaaacgttttgttttactgccctaagaaaatacacatctctaggcttgtctgaccagaaagccagcaaagtcttttgcatcgggtgtggcccttttgtattttatttcccatatttaaataagccttccttaaaccctagccccagtcctgagagctttgagggtagccgaaaccccttatctaataaagtctaactctgtgagaaccacagaatcttcttaagcttctcaattttctgtctcctttcaggcgccacgtcccttgtgctggcgggtcccccgttggctttcttgccgtttcttctcatctgtgtctcctgcagaggcggctcggagtcccgagtcttctagtcagttgaacaagcattcatttgtgttttcacccagattacagacacacacacaaacagacacacacacttggagctagtgagtcatgctggcagctgacattgtgactctggaacagccccggtgctctgtgggccagctcccccagcctgggggcgggaagctacatctgcagtacctctgctccgtatcttgtgggctgcgactcctggagtcggaccactgcagcgtcagtgatgttcgtaagctatggttgagcaaaggaacacacacctacacaccttgcttcttcccactagccaaacctgggacccagccatcagcctgtctctgtgggagtcgcaatggaagtagccctctattggcgtgaacatcagctctgatttatttaggaattgctccatccacagactttttttctggaagcagctagcttgctcatacttctatagcaccacagatccttcccagtaccatggctttcacttgccctcagacacccagagatccctgtctccccattgtgggtcctcttccttgtcctgccacctctgtcttccacaaggtgggccagggcttctcttgtaaccatgtcacttagggacactgcagctgggccttgtaccagttgtgaagactgggtattaagtgaaagtggtagttggtgtcttagctacgttggttttatgaccaaagtctgacagaagggctcttcccaaatcccacctgccctccctaagcctatttgcatcttcctctttgggccttatggtgttgcagtcactgtgatggtgacattcactggagaatccgtggtttcttgtgcaggatccaaacctggggtggtggttggtgtttcaaggcctatgaagagcatatgtgggc

SEQ ID NO: 116002 - DNA, 1745 bp, Homo sapiens
  Payload ID: 2633
  Gene Symbol: CDON
  Gene Name: cell adhesion associated, oncogene regulated
  ENST ID: ENST00000531830
  CDS Start-End: 1-731
agaattacttaatccttccatcaggaaatcttcagattttgaatgtatccttagaggacaagggatcatacaaatgtgcagcttataatcctgtcacacatcaattaaaagttgaacctattggccgaaagctccttgtgagtcgtccttcttcagatgatgttcacattcttcaccccacccattcacaggcattagctgttctttctcgtagccctgtaaccttggagtgtgtggtgagtggggtcccggctcctcaagtgtattggctaaaggacgggcaggacattgcaccaggaagcaactggagaaggttgtattctcatcttgccactgatagcgttgacccggcggactccggaaactattcctgcatggcgggaaacaagtctggagatgtaaaatatgtgacttacatggttaatgtacttgaacatgcttccatttctaaaggactacaggatcagatagtgtctctgggtgccacagtacactttacctgcgacgttcatgggaacccagcccccaactgtacctggtttcacaatgcacagcctattcatccttctgcacgacatctaactgcaggaaacggactgaaaatcagtggggttactgtggaagatgttgggatgtatcagtgtgtagcagataatgggattggatttatgcactctactggaagacttgaaattgaaaatggacaggaaatttacgtaggaaatgtttaggagcccacagctatgaaacaactctaccatttattgacagtcttacttggtgaaagttgagaagggaactaataaggagacggtggattcaagccagttataattacggcaccagtaagtgcaaaggttgcagacggagactttgttactctgtcctgcaatgccagtgggctgccggttccggtcattcgttggtatgacagccatggattgataaccagccatccatctcaagtcctgagatcgaaatcccgaaaatcacagttatcaagacctgagggcttgaacctggagcctgtgtacttcgtcctgtcccaagctggtgcaagctctctccatattcaggctgtgactcaggaacatgcggggaaatacatctgcgaagctgcaaatgaacatggtaccacacaggcagaagcatctctcatggttgttccttttgaaacaaatacaaaagcagagacagtcacacttcctgatgctgctcagaatgatgacagaagtaagagagatggttcagaaactgggttactgagctcatttccggtgaaggtccatcccagtgcagtggaatcagcaccagagaaaaacgccagcggcatctctgttcctgatgcccccatcatactgagccccccacagacccacacaccagacacgtacaacctggtgtggagggcaggcaaggatggtgggctgcccatcaatgcttactttgtgaagtatcgaaagaatggcaggaaacagaacaagagtcttccagactgatgagtttgtcagagagatcccagtcatgctggatttaccaatcctaggaaagcactgagaatgaagtataatttccccccaaattggaattctaggaacccaatgatgtctttacatgtgtattcaaatgttttagcccttcaacataaagctctataaccacttttaaaacacaaattccttccctctctaaggtagtagaataccatttatgtagcaaataaagcagtttcttattaaaaacaa

SEQ ID NO: 116003 - DNA, 5803 bp, Homo sapiens
  Payload ID: 2633
  Gene Symbol: CDON
  Gene Name: cell adhesion associated, oncogene regulated
  ENST ID: ENST00000531738
  CDS Start-End: 388-2313
ataattaccaatgatacctattattttatacttattttattcttcattagcccaggaagaaagaaggcattgtttccattacaagtaaaggaaacagagtctgggagggcagtaacttgcttgaggccacacattagtggtcagatgcagagccaggagtctttctacagtgagaattgcagcgttcttgcagcagatcttctatttcttaatatgaagaagtattgtgtcttttttacttaccatgctgtattacttcttaaaactcttctagaattaaatgaatcctagttttgatcaaatgtgaccgaaagatttcctatcctccatctcctgcttttcttttctggtgtgttttctcttgggcagctggatgatggggttggcatgctgggaagctggcacacggttcgagtcccaggaagtgaaaatgagctccatttagctgagctggagccatctagtctttatgaagtcttgatggtagcaagaagcgcagcaggtgaaggccaacctgccatgcttaccttccgaaccagcaaagaaaaaacagcgtcatcaaaaaacacccaggcatcctctccacccgtgggcatccctaagtatcccgttgtttcagaggctgcaaacaacaattttggagtggtacttacagattcctctaggcacagtggagttccagaggcaccagatcggcctaccatctccactgcatcagagacatcagtctatgtcacttggattcctcgggcaaacgggggttctccaatcactgccttcaaagtcgaatataaacggatgaggaccagcaattggctggtggcagctgaagacatccctccttccaaactttcagtggaagttcgtagtttagaaccaggttcaacatacaaatttagggtcattgccatcaaccattatggtgagagttttcggagttcagcatctcgtccttatcaagtggttgggttccccaatcgcttttccagccgtccaataactggacctcacattgcatacacagaggctgtcagcgatactcagatcatgctaaagtggacgtacattccatcaagtaacaataacactcccattcaaggattttatatctattaccgaccaacagatagtgacaatgacagtgattacaagagggatgttgtagaaggttcaaagcagtggcacatgattggccacctgcagccagaaacctcctatgacattaaaatgcaatgcttcaatgaaggaggagaaagtgaatttagcaatgtgatgatctgcgagactaaagtgaaacgtgttcctggagcttctgaatatcctgtcaaagacttgagtacccctccaaattctttgggaagtggaggaaatgtggggcctgcaaccagccctgccagaagcagtgacatgttatatctgatcgttggctgtgtgctgggcgtcatggtcctcattctgatggttttcattgcaatgtgcctgtggaagaatcgccagcagaataccatacaaaaatatgacccaccaggatatctctaccaaggatcagatatgaacgggcagatggtggactacaccactctctcaggagcaagtcagataaatggaaatgttcacggaggcttcctaaccaatggcggtctcagcagtggctattcccaccttcaccataaggtccccaatgcagtcaatggaattgtgaatgggagcctaaatggagggctttactccgggcacagcaactctctaaccaggacacacgtggattttgaacatcctcatcatctagtgaatggtggtggaatgtacacggccgtgcctcagattgaccctctggagtgtgttaactgccgaaattgtcgaaacaacaataggtgtttcaccaaaaccaacagcactttcagcagcagccctcctcctgtggtccctgtggtagcaccttatcctcaggatggtttggaaatgaagcccctcagtcacgtgaaggtgcctgtatgcctgacttccgcagtccctgattgtggccagttgccggaggagagcgtcaaggacaatgtggaaccagtccctactcagcgtacctgctgtcaggacattgtaaatgacgtcagctctgatggctcagaagatccagcagagttcagcagaggagacagctgtgcccattcagaaacagagatcaacattgtaagttggaatgctcttattttgccacctgtccccgagggctgtgctgagaagacaatgtggtctccacctggcattcctttagacagcccgacagaggtccttcagcagccccgggaaacctgaggacatgcaaacaaccagtcatgttccaacttcaagccggtaactgcacacaacaggcctgggagcgaactgtgtgaaggaccttaattcaaatcagagaaaatcattatttatttttttgtagtagtaatgtcatatgaatgtatcttaaaacgtgtgcccttttatattatttatgccttaaatgttttcttccccattccttcctccccctcggtaggaaacaaccttgttttgcatagtattcagtcacctggagggcagaggggtccttccatgttttctaacagctatagtgacagcaagagctcctcatgcaaaggatcccatctcttggctgcttcggctaggagggaatgcaggggcccgttgaaggttgccaccagctgggttttcaggtggaaaatggtctttcaatagtgtattctcagacttttttttgtttgttttttgagatggagtcttgctgtcatccaggctggagtgcaatggctcgatcttggctcactgcaacctccgcctcccaggttcaagcaattctcccgcctcagcctcctgagtagctgggactacaggcacctgccaccacgtccagctaattgtcttgtatttttattagagacaaggtttcaggctggttttgaactcctgacctcaagtgatccacccgcctccgcctcccaaagtgcgaggattacaggcgtgagccaccacgtctggcctgtattatcagacttcctgagaacactttgaaatcaactgcagttgtgacccatgtttataataacagacctggctgacggattttacaagagtgccttccacagaagtggtaatgtgacctgttgactttgtatctgcacgtgggcacgagtgatgttcagtttgctaggcactagtcatagtgttatggacgtggtggagtgtaaggtcttgatgaattacggcagtatgcagaaaaggaaccaaggccagagagacaaataatgcctcatgtcccactgctttaaaattacattaatttataaaatggccactatgggctctttttgactgtttctcggagtaggaacaaaataagacattaaatggtggcttgaagagaaagatacacattttcagaagaaagaaaggggagggctgcagggagcctgtcttggcgggagctctccagtctgttggattagcacagggacacgcttatggtgccatgacgccgaaactagtcatcccccatctccagcataggcaacggcctgcaggggtgagtgtcagaaaagacttactttggaagaaaagggtttttttttgtttgtttgttttttgtttttttttgtttgtttgttttgggtttttttcctgaaatttcctgatacctttttcagaatgtcacccttgtaaataggcacctaaagccaagttggtcagcagagctcctgaccacggctgcctctgcgtgacaaggacatttgcagctgcctttggaaggctcttcacattaaaaaacaataattatgtaagtgtgtttcatagcttgagtcaagctttcaaggatcactgctcctttgtgcattgtgcatccctttggggaaagaaacagaaaattattctctttctatagagtcaagcaattccagcagaagtgaagaaatgttagtttcccagaaatcgcagtggaatagaatacaatactgtgttaaccaactttctgtataaatgcatcagtattcccttacatatgtctatatattttataatagaactgttagtgaaaatgtgcttgtttaagctgggtcactatgcaagagttacttccagtagaatgtagtgaatgtaattccctagtcggatattagggatgctgtagacccaagttctacattccagatgtccgtgcctatagtatactggatttattcttcatgttgcttaaatgcagttagctctggagggggatagctgcatcccttacttctgtgactagcaaaggacaaagtcccagcgcacagaatatgaaaacataccctgtgttagccaatcaagttacagcaatgctgtcacaaagggagttttagaaaactggggagtcattgtccgtagacagccattttgatttaggaaacaggtgtattagcatgagccttaggtcatgaactgcttttaaagattgagtttgaatatgggatctgtccacgaggaagagaaaatggctttacctttaggacaatctcattgtggactgctttatttatattattagtaacgctgttttaagtgttattctttttattgtattttatttataaaaaatgcctttatatattgaaatatataaatatatatatataaacacacacacacacacacacacacacatatatatatatatatataattgcctttatatttaggcggtatgagttctccctaagcgtgagttggctctgccctgcacaggcacccaaacagtcctacctaatgtcacttcaccaggaaatgagaggacatggtacagtgtgggagacagcactaacacgtgctgaataactactgtgtaccaggcactgtgctcggtgcttgttactgttaactcatttaacccccacaactcatctacaaagttggcattaaaatccccaagtcactcagtgagccatgggacctgaatccgaacctagtttatctggagccataatctgggctcctcccatttttccatactgctttccaaaagcattgtggttcactctttggatggaaccagtcccgttccgtatgctgtgatctatccctgccgtggaattcctccgaggctccaactccgcagccagagaagctgctctctggcctccgcgggcagagctctgcttatgacttcgtcttccagaggtccacatttctccccttgacgccccctgtctaccacctccacctggaaatttgatctttactgtgctcagtgatcacgaaattggtcaagcctattcatgttccttctcatctagaattctgtgtgattgttttagcataaactgccccgctcccactgtatcatttcacgatctccttttaatgtttttctttcagttttgcactgacagtctggtgacaggtgctgccagggtgcaagttacattgcaatgttctaaaccttttgaagtgttcttagcaaaagcctttctttctgggtgtttttgtcgaatgagtctatgaagactcaatgcatccatcttgggctgatcatgccacagatctcattccagctatagtactgccaagaagtgaagtttatcattgaattttacctgtgttgctctcttttaaagtaatgactttgagatgcatgctttgtatcatattgaaaagtatgttttattttccttaaagttgtaatattgtgtgtgaaactgtacatattttaaatgatgtagctttggcaggttttatttggttgatatgattttatattaaaagagaaggctgctttcat

SEQ ID NO: 116004 - DNA, 624 bp, Homo sapiens
  Payload ID: 2633
  Gene Symbol: CDON
  Gene Name: cell adhesion associated, oncogene regulated
  ENST ID: ENST00000531586
  CDS Start-End: 129-624
gtctctccaagggaatgaaaggtgaggggagcgtgagtgcaggcatgatgggaatctccgtgacttgtgaaccaaggactgggttttgctctggaagcctgtcctgattgcttctgtaatctggcgctatgcatccggatcttggacccttatgtacactgctgtatgttactcttacaattctgtgctcttctgtgagttcagacttggcaccttattttacttctgagccgctctctgctgtccagaaacttggtggacctgtagtactgcattgttctgctcaacctgtgaccactcgtatctcatggctgcataacggaaaaacattggatggaaacctggaacatgttaagattcatcaggggactctgacaattctttctctcaactcctctcttttgggttactaccagtgccttgccaacaatagcatcggtgccattgtgagtggccctgcgacagtatctgtggcagttcttggtgattttggttcatccacaaagcatgttattacagcagaagaaaaaagtgctggtttcattggctgcagggtaccggagagtaaccccaaagctgaggtgcgctataaaatccggggaaaatggctggaacattccacag

SEQ ID NO: 116005 - DNA, 1948 bp, Homo sapiens
  Payload ID: 2633
  Gene Symbol: CDON
  Gene Name: cell adhesion associated, oncogene regulated
  ENST ID: ENST00000534661
  CDS Start-End: 1-1948
agacttggcaccttattttacttctgagccgctctctgctgtccagaaacttggtggacctgtagtactgcattgttctgctcaacctgtgaccactcgtatctcatggctgcataacggaaaaacattggatggaaacctggaacatgttaagattcatcaggggactctgacaattctttctctcaactcctctcttttgggttactaccagtgccttgccaacaatagcatcggtgccattgtgagtggccctgcgacagtatctgtggcagttcttggtgattttggttcatccacaaagcatgttattacagcagaagaaaaaagtgctggtttcattggctgcagggtaccggagagtaaccccaaagctgaggtgcgctataaaatccggggaaaatggctggaacattccacagagaattacttaatccttccatcaggaaatcttcagattttgaatgtatccttagaggacaagggatcatacaaatgtgcagcttataatcctgtcacacatcaattaaaagttgaacctattggccgaaagctccttgtgagtcgtccttcttcagatgatgttcacattcttcaccccacccattcacaggcattagctgttctttctcgtagccctgtaaccttggagtgtgtggtgagtggggtcccggctcctcaagtgtattggctaaaggacgggcaggacattgcaccaggaagcaactggagaaggttgtattctcatcttgccactgatagcgttgacccggcggactccggaaactattcctgcatggcgggaaacaagtctggagatgtaaaatatgtgacttacatggttaatgtacttgaacatgcttccatttctaaaggactacaggatcagatagtgtctctgggtgccacagtacactttacctgcgacgttcatgggaacccagcccccaactgtacctggtttcacaatgcacagcctattcatccttctgcacgacatctaactgcaggaaacggactgaaaatcagtggggttactgtggaagatgttgggatgtatcagtgtgtagcagataatgggattggatttatgcactctactggaagacttgaaattgaaaatgacggtggattcaagccagttataattacggcaccagtaagtgcaaaggttgcagacggagactttgttactctgtcctgcaatgccagtgggctgccggttccggtcattcgttggtatgacagccatggattgataaccagccatccatctcaagtcctgagatcgaaatcccgaaaatcacagttatcaagacctgagggcttgaacctggagcctgtgtacttcgtcctgtcccaagctggtgcaagctctctccatattcaggctgtgactcaggaacatgcggggaaatacatctgcgaagctgcaaatgaacatggtaccacacaggcagaagcatctctcatggttgttccttttgaaacaaatacaaaagcagagacagtcacacttcctgatgctgctcagaatgatgacagaagtaagagagatggttcagaaactgggttactgagctcatttccggtgaaggtccatcccagtgcagtggaatcagcaccagagaaaaacgccagcggcatctctgttcctgatgcccccatcatactgagccccccacagacccacacaccagacacgtacaacctggtgtggagggcaggcaaggatggtgggctgcccatcaatgcttactttgtgaagtatcgaaagctggatgatggggttggcatgctgggaagctggcacacggttcgagtcccaggaagtgaaaatgagctccatttagctgagctggagccatctagtctttatgaagtcttgatggtagcaagaagcgcagcaggtgaaggccaacctgccatgcttaccttccgaaccagc

SEQ ID NO: 116006 - DNA, 722 bp, Homo sapiens
  Payload ID: 2633
  Gene Symbol: CDON
  Gene Name: cell adhesion associated, oncogene regulated
  ENST ID: ENST00000527967
  CDS Start-End: 295-722
ggtgcgaggagacccgggaccccacgcccgcccgccctgcccagcgccccagccccggcgtgcgaggcgccgctccctcctctgccctgcgcggtgcatggaggggcccgttcggatcgcagccgccgccaccgtagccgccgccgcgcgcgcgcggggggatgacctgggggtggctttccgagccggctgcagcgcaggaggtctggaggcttagccagccccgcggagagtgaaccaaggactgggttttgctctggaagcctgtcctgattgcttctgtaatctggcgctatgcatccggatcttggacccttatgtacactgctgtatgttactcttacaattctgtgctcttctgtgagttcagacttggcaccttattttacttctgagccgctctctgctgtccagaaacttggtggacctgtagtactgcattgttctgctcaacctgtgaccactcgtatctcatggctgcataacggaaaaacattggatggaaacctggaacatgttaagattcatcaggggactctgacaattctttctctcaactcctctcttttgggttactaccagtgccttgccaacaatagcatcggtgccattgtgagtggccctgcgacagtatctgtggcagttcttggtgattttggttcatccacaaagcatgttattacagcagaagaaaaaagtgctggtttcattggctgcagggt

SEQ ID NO: 116007 - DNA, 459 bp, Homo sapiens
  Payload ID: 2633
  Gene Symbol: CDON
  Gene Name: cell adhesion associated, oncogene regulated
  ENST ID: ENST00000534818
  CDS Start-End: 126-459
tcgggggacagagtcgaccatttggagacctgccagaagagccgtctctccaagggaatgaaagtgaaccaaggactgggttttgctctggaagcctgtcctgattgcttctgtaatctggcgctatgcatccggatcttggacccttatgtacactgctgtatgttactcttacaattctgtgctcttctgtgagttcagacttggcaccttattttacttctgagccgctctctgctgtccagaaacttggtggacctgtagtactgcattgttctgctcaacctgtgaccactcgtatctcatggctgcataacggaaaaacattggatggaaacctggaacatgttaagattcatcaggggactctgacaattctttctctcaactcctctcttttgggttactaccagtgccttgccaacaatagcatcggtgccattgtgagtggccctgcga

SEQ ID NO: 116008 - DNA, 1766 bp, Homo sapiens
  Payload ID: 2634
  Gene Symbol: CADM1
  Gene Name: cell adhesion molecule 1
  Uniprot ID: Q9BY67
  ENST ID: ENST00000331581
  CDS Start-End: 172-1587
agggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagacacaacggcgacgacagaaccagcagttcacggccttactcagttgcccaattccgcagaagaactggacagtgaggacctctcagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtaca

SEQ ID NO: 116009 - DNA, 8588 bp, Homo sapiens
  Payload ID: 2634
  Gene Symbol: CADM1
  Gene Name: cell adhesion molecule 1
  Uniprot ID: Q9BY67
  ENST ID: ENST00000452722
  CDS Start-End: 22-1350
agtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgttgcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaatgttacaaagtgatcctttaatctctttatggacttcttatggacgcctccgagtgagagaagagatgggcctctggtcccagcttcctccttaggaccatgtacggggccaggaacgctggcagtagatgctaggacatgctgccggctgggttgctgggggccgcgctctctctccttctccgctcatccttcctgtccttgttctcttccccactctcagtggacaggtgagccaagtgctgtgccgtggctgagtctgggctcccacgtggactcagcgatttgtgcaggtgtgcgagctgtcgtggcgggcccgccggaacaggccgctcccgtagatgtgtcttccgcactcatcccctctctcaccgcccccccaccctcaccaacttccctgtgttggctgctccacctgtctcttactttgggagtttgtgtcttaacaattcattctgccttcttccttgaaagttctctctcctttcataaaaagaagacgtgagctgtggaggactggcttggctgcctgcagaagattgttctcacttgctgtttaggttgctgagacttccaggcctgggtagacagcaggatttgctctgttgtcatcgtccttgccttgcaggctgaagtgagcaatgactacacttcatggtggccgatcttataaatgtgcagataacgtctggccaggcccaaagtgcccttttcccaccatcccctcagctgtggttgatgagttccccttttctcccttggccacgtcatggggaaagttccataggaaaagcaaaggtaagctccagaaagactgaaggctgtgcatctccccttgagccacttccatcctggcctggtctcttacctgtctctgttaaaaaaaaaaaaaaaaaaaaaaaaaaaaaaaaatcagatatgcagttattgagcacctgctgtatgtccagcatggtgagggatgcagagaagtataaggcggtctctggaggccaagtagagcatcagttacatcacctgaaaacttgaagtgaccctgagccatgggtgccccactgaacacagagaagcccagagagtgctatgagaattttctggagaagggtaatcagtgaaggctggtgagtccctagacagcttcacaaagagctgggaccccagctggatcttaaaggatggtttcgtggagaaggaatgtgagtcaaaagtacagagggcaacaagcccagccagcctgctgatttgtatggggagaagaaagcaattccgtgtgcagggtgggatgggtcttgtggctgtactgaaaagtccgggcagaggactcgatacttcagtgacctctcccagcctctgccagagggcaaggagcagtagggagtactcattcattgcatctctataaaaagacccagagagatagaataaggatcaaaagcacacactagagagaggctgcctgcattcagatccctgtcccaccatgtagcagtgaaacctcgggtgagtagcccagcctacctggcttcagtctcttgctctgcaaggtggacatcaccatagcctcgaaggttgttaggaaagatcagtgagatatgcagtcagcgctcagccaaaaaggtgccagacacacactacttgttcattacatgtcagtcacaggatagaggcaaatggtgactaaaacgatagaaggttacccagggctacgaagaagcggtcactactcagagggagctctgagggctcctctgcatatagacacatcatgcccttgcaaaccacgacttagaaggtttaatgacccttttctcttcaccattcattagcagacttattccaagccacgtggcatgcagtatgtttagtctccccacccctctccctcttgtctgcagcatgaggctccagctttagctgtaccctacagaaaaaagtcccagaagttccttgagctgaggcagacaggaggtggtgactgctgtacatttgccttttgagctccacagggtatgcaaatgagaaggtgctagaagccgtccccgctcaaaggatcttgataagttgcccactccttcatttgagaagagtgcgtacgagagtgaaaatggccctcgtttcccccagagagttttcacaaatgttttggcctggcattctccaaatacatcaactggaaccctgaggtgatatgcgggtgttaattggtgcaatctttcactgtcctctgtctacctgaaatgtaattcttttaccgctgtggacttgctccatggagaaatgctcctttgattctgtcatcaagaacctcaaagaaaccatgtggccactgtgttacaggtagaaagaccctgcttaagtgaaggtatttttgttttattataaaatcatgcccaagattaatacacctttttgccaggatcccaaatacgcagccctttgtcatgaagaactggcagccacattccttcagggtgaaatttgtattcacagccatacatgtatagtttttgaagcgctggccccccgtacaggagaagaaagaagggactcttggctcatccatgaccttgtaggtcaataccatattaaagttcctgtcaggcacgcagtagtcacccagcaagtatcagctgattaaagggagaagagtcgagcacctggctgactgagccttacgttacacttaatctgaatgggccaccgatgctgtatttcaaaccttgatgtttgcatgtccatccttactacaggtggctttcaggttggccgtgaagggacaagccagccagtcctgagtttagagcgattggccctatcattctcaaggacccactggaatagtatcagggaatatcattttgggtaatggccaagcaaagccttagtattgctatcatatattgtgaggggccttcagaatgcaatatggcctcttttaaaaatgcaaactatagtccttgccttatctgtgtttatctcaaaatgttgaaatgtgcctctaataggaactgcaggattcagtccccccccaccaccccccacccaacactcacatcattacacatgagcatccctgaactgagacctgaaagcaagaatcttctctgttttcaggtgttccaaacctcagcttccagcctcttcagtacacaggaaactttgtttcatttttatgtttttatttatttttttcattcccaaaaaacataaaatgtctactgcccctggtggtcagtgctgggaaatacaactcgagccttgcctattgaaatgcagaatgtattccaacaaggaacctgacattgtctactgctttttctctcacacacatgcacacctacctgcgcctcccattttactccctcctaatccttcgaagtgttgatctggggaaggtgagaaccactactgaggggcaaatcaaccggttctctgggcccgggacttcagctgccctccagacgtgcacaggctcacagtcatatttcagacgtgaccgcctcaaatcttccttaagtgctatcttctcaggttaattaatcaccaggcttaaacttgctgttaccagcaggaagtccatcctgaagtcagcaatgttacgattgcatcttctaatactgtttatcctgcattagtgtttacttagggggaaaattgatccgtaattgatatttcagtcttccagagctggtgttggaagagcctaatgcaggcctttaatagcaagcaaatatttaaatcccttaatggttgctgaatattgaaatgtgtgactttattactctttttggtttgttttctctgtagttgtgtatttcatcgtttaaacctgcaatggatgctggcaagtgcaagtctagctaatccacaaaagctgtttgcccagacacagcagacctgattaaaaagtattgctatggaagggaatcttctgcactaatcagtctctgttagctagtgacgaaattactatccatctctctctctttctctttctctccctctctctaggcctgttttctctaacctcctctcccagaataaagtgatgagggcagctatagtgttgcaattaggaacatgaatcttttatcgtttggacaaggaagggaaaatgccattactgtcaactgaaatgtcctacttgggttttttgctcctacttccctgccaaagcccattgctgctgctgaaattgtataacattcacagctgttcttgatggcttgattcttaacacagccagaaatgtagcccgggagatgcttaagacagtttatggaaaataatagatttccttgcagagacaccaatgcatcgagaagggccttgagtcacgttagccccagccaagatcaccaattttctctctatctggcttcagttacaaaggctatgcctt

SEQ ID NO: 116010 - DNA, 4223 bp, Homo sapiens
  Payload ID: 2634
  Gene Symbol: CADM1
  Gene Name: cell adhesion molecule 1
  Uniprot ID: Q9BY67
  ENST ID: ENST00000542447
  CDS Start-End: 130-1374
ggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgttgcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaatgttacaaagtga

SEQ ID NO: 116011 - DNA, 581 bp, Homo sapiens
  Payload ID: 2634
  Gene Symbol: CADM1
  Gene Name: cell adhesion molecule 1
  ENST ID: ENST00000545094
  CDS Start-End: 36-581
agcagaaaactgttcagagatctgctcccattgcaatgaaggcatctggacataccagtggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggg

SEQ ID NO: 116012 - DNA, 3550 bp, Homo sapiens
  Payload ID: 2634
  Gene Symbol: CADM1
  Gene Name: cell adhesion molecule 1
  Uniprot ID: Q9BY67
  ENST ID: ENST00000537058
  CDS Start-End: 22-1383
agtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagacacaacggcgacgacagaaccagcagttcacgattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttcttttt

SEQ ID NO: 116013 - DNA, 629 bp, Homo sapiens
  Payload ID: 2634
  Gene Symbol: CADM1
  Gene Name: cell adhesion molecule 1
  ENST ID: ENST00000543540
  CDS Start-End: 393-629
gcagcagagtgtgcctgtgaggccaggagcgtggagctctcaaaggaccatcttgtttttctggttttaaaccaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcg

SEQ ID NO: 116014 - DNA, 3520 bp, Homo sapiens
  Payload ID: 2634
  Gene Symbol: CADM1
  Gene Name: cell adhesion molecule 1
  ENST ID: ENST00000536727
  CDS Start-End: 22-1353
agtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgacacaacggcgacgacagaaccagcagttcacggccttactcagttgcccaattccgcagaagaactggacagtgaggacctctcagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttcttttt

SEQ ID NO: 116015 - DNA, 833 bp, Homo sapiens
  Payload ID: 2634
  Gene Symbol: CADM1
  Gene Name: cell adhesion molecule 1
  ENST ID: ENST00000542450
  CDS Start-End: 502-833
ccttcccaggatttcatcgagatcccaaagagtcactcactcacacacgatgaactgcctatacattgggactgtcaacatcaactaacaagacgagattatttattgaaccctcctacctacttctattaagtggctccttgagtttctgtgaggctgaccaaatagcttagctcaagggcaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccg

SEQ ID NO: 116016 - DNA, 565 bp, Homo sapiens
  Payload ID: 2634
  Gene Symbol: CADM1
  Gene Name: cell adhesion molecule 1
  ENST ID: ENST00000543249
  CDS Start-End: 1-565
aatccggggacctgccttcttactctccactcccgcacagcccccgttcccaaagatctattccttcggtgcaaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagct

SEQ ID NO: 116017 - DNA, 2373 bp, Homo sapiens
  Payload ID: 2634
  Gene Symbol: CADM1
  Gene Name: cell adhesion molecule 1
  ENST ID: ENST00000545380
  CDS Start-End: 1-1240
gagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtgg

SEQ ID NO: 116018 - DNA, 572 bp, Homo sapiens
  Payload ID: 2634
  Gene Symbol: CADM1
  Gene Name: cell adhesion molecule 1
  ENST ID: ENST00000540951
  CDS Start-End: 22-225
agtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtctcacttcatcacccaggctggagtgcggtggcacaatctcggctcactgcagcctcggccttcccgtgctcaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaag

SEQ ID NO: 116019 - DNA, 1300 bp, Homo sapiens
  Payload ID: 2634
  Gene Symbol: CADM1
  Gene Name: cell adhesion molecule 1
  ENST ID: ENST00000621043
  CDS Start-End: 1-1293
ggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagacacaacggcgacgacagaaccagcagttcacggccttactcagttgcccaattccgcagaagaactggacagtgaggacctctcagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcc

SEQ ID NO: 116020 - DNA, 4054 bp, Homo sapiens
  Payload ID: 2634
  Gene Symbol: CADM1
  Gene Name: cell adhesion molecule 1
  ENST ID: ENST00000621709
  CDS Start-End: 1-1206
ggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgttgcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaatgttacaaagtg

SEQ ID NO: 116021 - DNA, 1042 bp, Homo sapiens
  Payload ID: 2634
  Gene Symbol: CADM1
  Gene Name: cell adhesion molecule 1
  ENST ID: ENST00000612235
  CDS Start-End: 2-1042
aggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgattcccgagcaggtgaagaaggctcgatcagggcagtggatcatgccgtgatcggtggcgtcgtggcggtggtggtgttcgccatgctgtgcttgctcatcattctggggcgctattttgccagacataaaggcctgttttctctaacctcctctcccagaataaagtga

SEQ ID NO: 116022 - DNA, 3970 bp, Homo sapiens
  Payload ID: 2634
  Gene Symbol: CADM1
  Gene Name: cell adhesion molecule 1
  ENST ID: ENST00000612471
  CDS Start-End: 1-1122
ggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgttgcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaatgttacaaagtg

SEQ ID NO: 116023 - DNA, 1246 bp, Homo sapiens
  Payload ID: 2634
  Gene Symbol: CADM1
  Gene Name: cell adhesion molecule 1
  ENST ID: ENST00000616271
  CDS Start-End: 1-1239
ggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagacacaacggcgacgacagaaccagcagttcacgattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcc

SEQ ID NO: 116024 - DNA, 9488 bp, Homo sapiens
  Payload ID: 2635
  Gene Symbol: CADM2
  Gene Name: cell adhesion molecule 2
  Uniprot ID: Q8N3J6
  ENST ID: ENST00000383699
  CDS Start-End: 628-1842
ggtgcttcgtagagctgccgccgtcgccgctgccgctgccgccacagccgccgctgcagccggagcatccgggagccgccactgccgccgccgctgccgctgctaccgccactagcgctgcttccactgcttctacctcccctcccaggaccccgagacaccccgggcgcgagcggcagtgctgcttgcttgctcctcctctcccccagcccttcccctccgtgacctacccactccttgcagccctcgcccgcaccttctccaacaccccggcatccctgcaccacctgctcgggcagccccggcgggctctgggacttgctgtgcgcgccgagaggaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcaccagcatctacttgccccctcgttccttccccagccctttagagaagggaccatgatttggaaacgcagcgccgttctccgcttctacagtgtctgcgggctcctgctacaagcggctgcttcaaagaataaagttaaaggcagccaagggcagtttccactaacacagaatgtaaccgttgttgaaggtggaactgcaattttgacctgcagggttgatcaaaatgataacacctccctccagtggtcaaatccagctcaacagactctgtactttgacgacaagaaagctttaagggacaataggatcgagctggttcgcgcttcctggcatgaattgagtattagtgtcagtgatgtgtctctctctgatgaaggacagtacacctgttctttatttacaatgcctgtcaaaacttccaaggcatatctcaccgttctgggtgttcctgaaaagcctcagattagtggattctcatcaccagttatggagggtgacttgatgcagctgacttgcaaaacatctggtagtaaacctgcagctgatataagatggttcaaaaatgacaaagagattaaagatgtaaaatatttaaaagaagaggatgcaaatcgcaagacattcactgtcagcagcacactggacttccgagtggaccggagtgatgatggagtggcggtcatctgcagagtagatcacgaatccctcaatgccacccctcaggtagccatgcaggtgctagaaatacactatacaccatcagttaagattataccatcgactccttttccacaagaaggacagcctttaattttgacttgtgaatccaaaggaaaaccactgccagaacctgttttgtggacaaaggatggcggagaattaccagatcctgaccgaatggttgtgagtggtagggagctaaacattcttttcctgaacaaaacggataatggtacatatcgatgtgaagccacaaacaccattggccaaagcagtgcggaatatgttctcattgtgcatgatcctaatgctttggctggccagaatggccctgaccatgctctcataggaggaatagtggctgtagttgtatttgtcacgctgtgttctatctttctgcttggtcgatatctggcaaggcataaaggaacgtatttaacaaatgaagctaaaggagctgaagatgcaccagatgctgatacagccattatcaatgctgaaggcagccaagtcaatgctgaagagaaaaaagagtatttcatttaagatgcaggccaagattctgagttttactaccaggctgaatgctggagaaaactggctatcatctttcagaagtcatttctaccatcgtctgctacccttattaactcccatactgtactgctatcagtagccagtgtataccaacaatcagctgttgaaagcatcattctttaattactgtaccatccataatgcaggacatttcttactgcctaaatttcacaccattgctcttttaacatacagtgcttgaatatacagccttaacaatgttaatcatctccttggatcattatattgagtggtttttatacattaaaaaatgtatgcagagtttttttcccccattttttcccctttaagtcatagaccttatcagtttgccattggacagctttcacaagtaacaggattagggaaggacataatgtatttaagaataagtgaaggttagaggtttacaattaatgttttctacatgtctgtcttcaaagacaacatgctttggaaacatatgtcctagaaaacataaaattaaaaaaaaacactatagtgtagtttttggaatgttggagattatactggtaaagctgtatcgatttgctattgaaatatagtatttgatacaggagccatgtgtacgaattgcaatcatgacatggtattttctataattatagagatcttactattaggatattgtagcttcatttaccaataaattattccaaatgatttactgcttttggaatcacaaatatttaattcatttctctaatttgattctataatttatttgcttcataaagattcacctgcctaaacaatattgaagtatccatagggcacaattttcagacattttagtatctgtatatagtgcatataataaatccaattaaacattatttgatacatatttaacttttttggctgtatgtaattcagtcataagtaagcattttctaacgtccattatatccctttaggtattacttaaaccaatattataagtagataacatgtattagtatttttgtctgtatgtcctagcactgttcaacaacaaatttttctagttcttgttaatttttatttgttatacaatggaagcacaatgttataaggaaaggtaattttaagctaacaaccagtgcacagcctcaggttttaaattacaaccacagttgaataataacctaaaaataaattttagtttgctaaaaatttacaaattttcattttgcagttccagagctgcttacctatgttggtttgccaaaaagaagtgtttaagatatgttttctgtataaatgaactaattctttatattaaattcctgtctatgcattttgtgaggtacaaactgatgaaacagtgagtgatagagaatttctgccatgcttttaactccaaagtgaaagtctctttctctggattattttaaaattttggcgtgtttaaccattaagaaatgctgtattcttaaatatgaaacagttaatctaaagtcttattatttcttctagtaaaataaaatattgttagattagttctcattaaatttattatatgctaaagaataaaactccagttagatttaaaaaaatcccatttacaagcattgcacctttaagaagaaaacaaatatgacagtatggtagctatacttgtgatgtctgacgcatgatggcctatggttttaaaaatagtattgtggaatatatttttgggtaataagaatggttgagtgcaacatcatgtattaatatcaaatgaaagacaagggtgctgtatctttgattatttatcaaaaaagtataaatcttttaaggaaaatgttagaattttaaagtttttttttgattgttgaagcatttatcttgttgatttcttacaaaagaaaaaggacgatgtcagtcaagcagcactttttcagaatatacagaacataaataatatgatgtggttgagtgttaacataataaatcatatacagtatgacattttaaggaaataagtctgcattgatgtgattgcatgcttgtttttacagttcactccataccatctgtggaaaaatgcaataatatgttaatatagtatggtagtttgagagaatcaggtaggtgctactagacacattgaaactagaataggtttataaactgttcatatctttcaatgcataatctttagaaagactccacaaagcaaaattcatcctgttagtacaaaatggaaaggttcttattacagaagtaagttgtacaaactgcatcatcaattactatgtaaagcctaatttcaggatgcacttacaaaattgctactcttcatcgatgccgtatttacatccctcttcatttcatctatattctacttggctccaacaactaaattgttgcctaaataactcaatcattatttatagcactgtaaaattagaaatccaaaattggttgcatttcatgatttttgactcttttaacccttcagagtaatataaaatctcattagaactcttataaaaccagttagctaaaacaactagattattatactagttataaatgctggtatattataatttgtgggatctaattaaatgtttgcctattaaatatagtttgatttaaatgagacaccatgttctgaactggagaaaacaatatcaatgaagtcatattttcatacctttaaaaattatttaattttcaaccaaacaaaaaataaattgtaaaaattatgctcatttctattccaacaagtcagaaaataatgacataatatttctaaatgagaatgatgtcaatttcattgtctggaacatgcacacttgtgtgcacatagagtcaatttctgtctcttctaagtgagcacagtaggtagggaactcaatggaagcagtgtgcacacacacacacccttagtagaatatggagcattattctttaccaaaagtagctattctctgccagtgtactgtttacagtgtaaattgattgtcctccgtcaaaatcaagtctaagcggcattttacttttcttttcttttttattttccatttttgggtgttctagataggattattatcaaaagtaggaggaaaaagaaatgtttgtgagtgcaagattaaagacagagcgcatgagcagagtactgatggtgtgcgtgtttgtgtgtgtgtatatgtgtgtgtataagagagaaagagaaatcgaaaagagagagaaatttcaacttgttttcttttaccagagaatccaagaagcagtttaaggaacctgatattggagtttaatctagaaactggatgatctcatattgattcatgatgcttaatctttcattgaaactccacaattaaaataacaaatagagaaagaaaactaactttcctaaatatggcaaagaaactaacacctcatttatttttatttctttgtaaaaatataaatatctcaatcaaaagtacaggctcatttgtaattatgtactcatgattgtaacagcattgagatttcatataggcacatgtatagcagctgtttgacagtgatggctcttccatgtaacatagcagttatcgtgtaatttagtgccacttattgcaaagtgttaccaaggggaacatttcaaatgccttttgtttttctttggacatcaaggtaatttagtggacaacaaatattaaattttacattatgctttttaattgtggagaaaatgcaaaacctcatgtcttaccacaactttcccatggtattgctaattacttagagtctctaaaattgcccaatattatttccctttgcaaatggtaatttctgataaaacaatacaaaacaaaaaaaaagcagtaatcacagccaaataaatgaaacacctaatgagaattactgttgagtaatgctttttattaagtggcacaaagtacacactaaaaactatgcaaaatataggtaactacagtgtacgtacatgtaagtatcttgtacttgctgtgtatggatgttggaaacccatgtaattataatatgcattttgaatattgggaaagaggaaatcttagtgtagataatagaatttgttttgaaatatacactggcaatattgaaatatactcagtgcaatatctgcagttctattgctggatacttaatgcaaagggattttaaagaattcttcagcaagatccaagaggttgctaatcttcacctctcacatactaaagcattcattaaaaatacaactaattcaaggacaagttaagtttttcttattaatgtgacacagtaacatttttatttggattagtttttggtgttattgcagagaaagaaataacctgagttttaaatttcgattcatatctcattgaattgggaattcttcaattttgtttgaaatgtgtgcatgttttcatagattgtagcaagtacaaatgtattcaatgaaagaacatagggtagttttaatagttaaagtcactatatcttaatgggaattttaaaatatcttttctttttctattcattttttccctttctctctctattctacccccaaacaagccctttgcactcatacccttccaaaggcaatggattgaaagtagcaagataataaagagagttaaaggggacaacatataacaatgggttctaaaatcatcagcatttttatgtattgagattattaatattgaatgcaatagttattggatatagctggtaagttctctgccatgcatacttacaataatccttctacctctcacttttaacatgggctatgatacttcaatataaatagaggaaataattatttaccagatatcccaggaagcattcttatggaactattataacagtgcactccccaccccctgggaaatctcaaaagccaagttcttcagtgtattctatggtgtatgaatctgcatttgtttttccttttctatcattagcttttcctaaaggcaaaatattataactttataagaatagtccttctcctgcctatttaatatttcaatgttaatataattgtattggtttttaaaaataattaaaatggcaacactttgcgatccaatctgatatttaatttttaaaatgtaacaatttcttataaattcatgctgtgttttaagtaaaaatcatgtatatgaattattttaccaagtagtattatctgcacgagacaaatttaagtattttaaaaatcatccttattaataaataatcctcatataatgcacagtattgccacaaatgcccacttcattttgtctgcatagacatattaagaatttttcaatgatgtaatttaattatcctaaaagaaatgacagattcttctgtaggaaaaaataaaaacatgaatatctcaaattataatggttaatctctaaaatatgcttaaagtaagatgtttctatgttatgtggttatgttatcaataatatttggttgatcttcacatattttatatgcatatatatatcaagaagttatatatatataactcaagaaactcaagttatatatatatgtcaagaaatgtatgattattttggagagaatgggcccaaatgtgaaaaagatataaaaaaaacaaaaaaaacaaaaaaaaaacactattttcccctacgaaatatactgtatatttcaaaagaagaaaagttaaaagatatttgaagattgcaggggcaaaacaaaaacctaccagggctcagcacttaagcacttttcccacatccagggtcaaagcagcagtaactacatggacttttaagtgcggtatgaaatgcaacattacgcttacaaacagtactgtcaaacctcaaatgctttctttcttcagatgctttttcgtgtacatgatactagtagacacttttctctttatatttactgatagtgaaaatcatacgcaataaaatattgatgtttgaaggcagtggtcaccaattggttaaaaaactatgaaatgtaaactgaattgttatatctctatcctttttgcttttctctgtgtttttaatgtatggaataaatctcataaatagaaagaaaaataatctagaaatttttcaaagctagtactctttctccttataaatgtacacaattttaatctttttacaaatttatttaactgtacctactgtacttattgtagattcaatgacgcagttaagtcatcacccaaggatttatgaatttgagattactgacctgttttcttcatattgcattcacatcaatatttgtgaatttgttgttcagcttttcattcaaacaaaaaatattccctcaagaaagctccatttttatcataaacatttcaacataaccaacattagaacaagtctgccatgttaaaaataatttaaagacttatctctgaaaacggtatccagaaacgcaggtgttcccagtaatgtagcttcaaaaataaaatgtgctatttatatgacatgaaattcataacttttggaagggtatatttatgacagcataaaaaataaattctgtgctataaagaagatccaacaaattaaccatataagcacagaaaatagagaaacacagttattgaatctactcttgtcattaacattttcaaaaaacaaaatgcatattgtaatatttggtacatgacacttgcatgttgatatgcctatatacttacaaagtattcaatgtgtacttagcggcgcttaaaatatgtcatgtacaactcttataaacatttttacagggttcccatttgcacttcatctttcagtaaagtcttgtcagaaaaaaattgtctgataaatatggaaaaataaaatttgaattttagttatctgttggacattactgaattgtctattcatttagtacattttcttaaccttgaaaacagacattgaaagatggaactttcttttttccagtgacaggtcattaaatcgatggtacaaaacatacttctttatgccaaacacattattttgaatacctttttttcaacttcatacattatccatccattttagttttcctcgatgatgcccattttctttgtaaatttctaagtggaagttttaaaaattaagcatcagtaaaataaatgttatcttatttgtacaacatttaatcgttattccttggaatatatgaaccttgtaaagtgatgactaagggtcaaaaaaaatgttgctgacttagggaaatttgcttgagaatgccaaaattttaaaactctgtaaaggtaattttacattcacttatgtgtgtttactaatgttgagtaggaacagaagcaaaaatacctaaacctattttttttaaccttcacactctaaccagtattatatatttcagctacctaagataatgcaattaatcatatatccaacctaagcttctgccaataaggatttcagataagcttttaaatttatggaggattttctttgtgtctttggaagttcacttaccataaagtattttatagtctactttaaataacagattttgttacacagggtaagccaaaggctgtacaagatttagtgtcattgggtctcatatttgtgttagaccatgaaatattccattaaaatttatctgtaaatacaaggcaa

SEQ ID NO: 116025 - DNA, 1314 bp, Homo sapiens
  Payload ID: 2635
  Gene Symbol: CADM2
  Gene Name: cell adhesion molecule 2
  Uniprot ID: Q8N3J6
  ENST ID: ENST00000405615
  CDS Start-End: 1-1314
atgtttgttctcttcttgtgcaacctttccttggtaccagcggctgcttcaaagaataaagttaaaggcagccaagggcagtttccactaacacagaatgtaaccgttgttgaaggtggaactgcaattttgacctgcagggttgatcaaaatgataacacctccctccagtggtcaaatccagctcaacagactctgtactttgacgacaagaaagctttaagggacaataggatcgagctggttcgcgcttcctggcatgaattgagtattagtgtcagtgatgtgtctctctctgatgaaggacagtacacctgttctttatttacaatgcctgtcaaaacttccaaggcatatctcaccgttctgggtgttcctgaaaagcctcagattagtggattctcatcaccagttatggagggtgacttgatgcagctgacttgcaaaacatctggtagtaaacctgcagctgatataagatggttcaaaaatgacaaagagattaaagatgtaaaatatttaaaagaagaggatgcaaatcgcaagacattcactgtcagcagcacactggacttccgagtggaccggagtgatgatggagtggcggtcatctgcagagtagatcacgaatccctcaatgccacccctcaggtagccatgcaggtgctagaaatacactatacaccatcagttaagattataccatcgactccttttccacaagaaggacagcctttaattttgacttgtgaatccaaaggaaaaccactgccagaacctgttttgtggacaaaggatggcggagaattaccagatcctgaccgaatggttgtgagtggtagggagctaaacattcttttcctgaacaaaacggataatggtacatatcgatgtgaagccacaaacaccattggccaaagcagtgcggaatatgttctcattgtgcatgatgttcccaacactttgcttcccactactatcatcccctcccttaccactgcaacagtcacaaccactgtagccataacaaccagcccaaccacatctgcaacaaccagcagcatcagagatcctaatgctttggctggccagaatggccctgaccatgctctcataggaggaatagtggctgtagttgtatttgtcacgctgtgttctatctttctgcttggtcgatatctggcaaggcataaaggaacgtatttaacaaatgaagctaaaggagctgaagatgcaccagatgctgatacagccattatcaatgctgaaggcagccaagtcaatgctgaagagaaaaaagagtatttcatttaa

SEQ ID NO: 116026 - DNA, 1422 bp, Homo sapiens
  Payload ID: 2635
  Gene Symbol: CADM2
  Gene Name: cell adhesion molecule 2
  Uniprot ID: Q8N3J6
  ENST ID: ENST00000407528
  CDS Start-End: 63-1370
gccccgctcaccagcatctacttgccccctcgttccttccccagccctttagagaagggaccatgatttggaaacgcagcgccgttctccgcttctacagtgtctgcgggctcctgctacaaggcagccaagggcagtttccactaacacagaatgtaaccgttgttgaaggtggaactgcaattttgacctgcagggttgatcaaaatgataacacctccctccagtggtcaaatccagctcaacagactctgtactttgacgacaagaaagctttaagggacaataggatcgagctggttcgcgcttcctggcatgaattgagtattagtgtcagtgatgtgtctctctctgatgaaggacagtacacctgttctttatttacaatgcctgtcaaaacttccaaggcatatctcaccgttctgggtgttcctgaaaagcctcagattagtggattctcatcaccagttatggagggtgacttgatgcagctgacttgcaaaacatctggtagtaaacctgcagctgatataagatggttcaaaaatgacaaagagattaaagatgtaaaatatttaaaagaagaggatgcaaatcgcaagacattcactgtcagcagcacactggacttccgagtggaccggagtgatgatggagtggcggtcatctgcagagtagatcacgaatccctcaatgccacccctcaggtagccatgcaggtgctagaaatacactatacaccatcagttaagattataccatcgactccttttccacaagaaggacagcctttaattttgacttgtgaatccaaaggaaaaccactgccagaacctgttttgtggacaaaggatggcggagaattaccagatcctgaccgaatggttgtgagtggtagggagctaaacattcttttcctgaacaaaacggataatggtacatatcgatgtgaagccacaaacaccattggccaaagcagtgcggaatatgttctcattgtgcatgatgttcccaacactttgcttcccactactatcatcccctcccttaccactgcaacagtcacaaccactgtagccataacaaccagcccaaccacatctgcaacaaccagcagcatcagagatcctaatgctttggctggccagaatggccctgaccatgctctcataggaggaatagtggctgtagttgtatttgtcacgctgtgttctatctttctgcttggtcgatatctggcaaggcataaaggaacgtatttaacaaatgaagctaaaggagctgaagatgcaccagatgctgatacagccattatcaatgctgaaggcagccaagtcaatgctgaagagaaaaaagagtatttcatttaagatgcaggccaagattctgagttttactaccaggctgaatgctggagaaaac

SEQ ID NO: 116027 - DNA, 2546 bp, Homo sapiens
  Payload ID: 2636
  Gene Symbol: CADM3
  Gene Name: cell adhesion molecule 3
  Uniprot ID: Q8N126
  ENST ID: ENST00000368124
  CDS Start-End: 158-1456
agcgccggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacggctactggcaggagcaggatttggagctgggaactctggctccactcgacgaggccatcagctccacagtctggagcagccctgacatgctggccagtcaagacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttccttggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgca

SEQ ID NO: 116028 - DNA, 3745 bp, Homo sapiens
  Payload ID: 2636
  Gene Symbol: CADM3
  Gene Name: cell adhesion molecule 3
  Uniprot ID: Q8N126
  ENST ID: ENST00000368125
  CDS Start-End: 158-1354
agcgccggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttccttggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgcagtgagctgtttcctgcccaaactaagggaataatgtgaactgtgtgcatgtgtgtggtgtgtatgcatgtgtgcatgtgtgtgtgtgtgtgtgcatgtgtgtgagtgagtgagaggcagagcgaggaactgaggaggagggctaagagccaggggtcctgggcaagtggacagggctgtgggacatgttggggaggctttgggaatggggtattcctagtcagggttcacacctcacctgggatgttgttccatgctggtatttcctctgccacccccaatgcccatcggtcttggagaaaggagtccccgggtgtgtgtttgcccagctgtccattctatctctcccttaaacacagagcattcagcccttccctggatttccctcctctgagccatggagtcagtgccacagcctttgctatgcacctctcaggcctctccttggcgttgaccctggaaagacctaccaccacctattttttcccatagtctgtacccagtgagttgaaggctgggtccccacccttccttttgatttcctgtcttccttctcgtggccccagctggttgctgtggagatgaggttcctggtcctccctgtcctggctggactgccccgcctcagatccaggatgcccttggcatcgctcccaccctcccccagcttttcctccctggtctgacaatgggcatgcaaaaaggggcagctgcaatctagcaggcctgcccacccccttcagttcaggtaatacagttgtgaatcttccagccgctggttagggccttgggcaccacaggcagcccctcacctaagccggggcctactcctcttacaacagcaagagagccctggggccccaggcctgttgagcttcttgtctcccagcacccgcttttgggaaaatgacttttcctcttcaagctgaaccactctgtccatattacacagaagccatatttgtacgggggggtgggagggagaggggctgttgtgctgtgtgtgtctgtccaggggtgggggggtgggggaagggagcagggaggggaccgtgtatctttataatctttctaactctcctgtgctaatctcagaggggtcaccctcaatatatctggattatccgtgtcattcagctgcctcctttctggtcctcttgctgctgctgggatgtgtgtatgtgagggtcttcttcccataccccttgcacctggtgcctggtgcctcaaaaggtggtgtgtcccttgccaggccactctcaagaatatctatgtacagcaacaatataactctacaaggga

SEQ ID NO: 116029 - DNA, 711 bp, Homo sapiens
  Payload ID: 2636
  Gene Symbol: CADM3
  Gene Name: cell adhesion molecule 3
  ENST ID: ENST00000416746
  CDS Start-End: 8-711
aagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatgacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccagga

SEQ ID NO: 116030 - DNA, 2178 bp, Homo sapiens
  Payload ID: 2637
  Gene Symbol: CADM4
  Gene Name: cell adhesion molecule 4
  Uniprot ID: Q8NFZ8
  ENST ID: ENST00000222374
  CDS Start-End: 50-1216
tgcaggtgccgggccgggagcgagcggcggcggcggcggcggcggcaccatgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacgaccctggtgcggtggtagaggctcagacgtcggttccctatgccattgtgggcggcatcctggcgctgctggtgtttctgatcatatgtgtgctagtgggcatggtctggtgctcggtacggcagaagggttcctatctgacccacgaagccagtggcttggatgaacagggagaagcaagagaagccttcctcaatggcagcgacggacacaagaggaaagaggaattcttcatctgaccctatccccaccccaggcctaggcctgggcctgggctggggtcccccccactgccagctgcaaggaaccagcaaagacatttaccagagtctgggatggtgggcttctccccccaccactaacacctcagacgcttgggcagggatgggggtgttggatgcctggatctctgtaagggccagaagtgagggcccagaggtctgggtcccccagggggcaggggccaaaggtccagaccccccaagtccagtgagggcagtagggattgggttgggggaagataactgggggaaggccagggcccctaggctacaaaaccaggtcttgtggggagggggtcagtttctgggaagggtggggggggcagggaaggggaacacagatttctttgggggtcctagaccccatgccagccattgtaagagttccacagagctctgggcacttctttgcaaagccatgtttgcacggtggggggatgggtggggggagggcgtggaaatagggattctgtgtctttgtgtcataactttgatgggggcagtgagggagacagccccaacccttttctccaatcccccttccccaggttcctgggctccccttctctctaccttctcccccaacgtctgtcccatccatatttgtctctctgtccacccactcctgggggggccttccccatctctcctccaggccccccggggagggggaaaggagtttggggaggattcgtggtcttcatggttttatatataatatattaaaaaatcaaaagtctgtatgaaaatatcagattgcacccccctctccccattcctggcttttgccccctttttcttgttaaaaaacaaaaaacaaaaaacaaaaaaccacacacacattttgtacggggtggggaggggaatggggagggggtttggcaatctcactaaccaccattaaactgaggagagaacaa

SEQ ID NO: 116031 - DNA, 8023 bp, Homo sapiens
  Payload ID: 2638
  Gene Symbol: CHL1
  Gene Name: cell adhesion molecule L1-like
  Uniprot ID: O00533
  ENST ID: ENST00000256509
  CDS Start-End: 643-4317
agggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaaa

SEQ ID NO: 116032 - DNA, 5235 bp, Homo sapiens
  Payload ID: 2638
  Gene Symbol: CHL1
  Gene Name: cell adhesion molecule L1-like
  Uniprot ID: O00533
  ENST ID: ENST00000397491
  CDS Start-End: 468-4094
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattg

SEQ ID NO: 116033 - DNA, 594 bp, Homo sapiens
  Payload ID: 2638
  Gene Symbol: CHL1
  Gene Name: cell adhesion molecule L1-like
  ENST ID: ENST00000449294
  CDS Start-End: 341-594
agaaagggaagaaggcaaacaggaaaagagccagaagagcagagttcccagcagaggggaagcaagtggagaggcggtgtggaggaatcaatttggccccatctggaatggacagaaggctagaacctgcagtgcagtgagtgtgggagaaaccagctggcacaaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattcc

SEQ ID NO: 116034 - DNA, 1104 bp, Homo sapiens
  Payload ID: 2638
  Gene Symbol: CHL1
  Gene Name: cell adhesion molecule L1-like
  ENST ID: ENST00000445697
  CDS Start-End: 1-1076
agtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggaaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactgg

SEQ ID NO: 116035 - DNA, 723 bp, Homo sapiens
  Payload ID: 2638
  Gene Symbol: CHL1
  Gene Name: cell adhesion molecule L1-like
  ENST ID: ENST00000435603
  CDS Start-End: 181-723
gagccacagtgtctcagccaggggcagggccggggaactcctgcgaaaaaccacgggccggaggagcagcagccgcgcgggcccagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatac

SEQ ID NO: 116036 - DNA, 572 bp, Homo sapiens
  Payload ID: 2638
  Gene Symbol: CHL1
  Gene Name: cell adhesion molecule L1-like
  ENST ID: ENST00000427688
  CDS Start-End: 376-572
agaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaac

SEQ ID NO: 116037 - DNA, 3960 bp, Homo sapiens
  Payload ID: 2638
  Gene Symbol: CHL1
  Gene Name: cell adhesion molecule L1-like
  ENST ID: ENST00000453040
  CDS Start-End: 4-285
aaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcag

SEQ ID NO: 116038 - DNA, 543 bp, Homo sapiens
  Payload ID: 2638
  Gene Symbol: CHL1
  Gene Name: cell adhesion molecule L1-like
  ENST ID: ENST00000421198
  CDS Start-End: 254-543
tcggacagctcggggtcagtcgacggagcacaccgggcgcccgaatccgccgggtcccactcacgcccgccggccgccggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacga

SEQ ID NO: 116039 - DNA, 7311 bp, Homo sapiens
  Payload ID: 2638
  Gene Symbol: CHL1
  Gene Name: cell adhesion molecule L1-like
  ENST ID: ENST00000620033
  CDS Start-End: 95-3610
tttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggaaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatcc

SEQ ID NO: 116040 - DNA, 4853 bp, Homo sapiens
  Payload ID: 2639
  Gene Symbol: CCAR2
  Gene Name: cell cycle and apoptosis regulator 2
  Uniprot ID: Q8N163
  ENST ID: ENST00000308511
  CDS Start-End: 250-3021
gcacttccgctccccagttgccgcgggatggcaagccggcgtgggggaagggagaggtcggcggagacgagggagggaccatatccgggagagcggcagcttccgaccagtggtcgcgcttccggagaggcgcttccggtggcggcggcagcagcggctgtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggttttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttcgctccagaaggtgggccagggccggggaggtgcgcacacacccctggcatgctgggctgcctgctggagggtgctgctgctccgtggagggcagcaggcccaggaaggggtttcctctgctcgcctaagttacagcacaatactatgtggacgtttcattgaaaattttacttgaaaaaataaaattccagatactcaggtgagacacaaacccactgttcctgctttgagacctgtgaattcttgtgggacagttccactgacagcttgcgttcccgaggtaccagtcctcagtgacctcgggaaccccaaccacttaggtcccaaagccacaagggtgccctttgtcttgctgggaagctggctgagggcctgccagggctggaggaccagctctcccgcacagggttcagggcctctcccagaaaaaagaggttttgaagtgaaaaggcaacgaggggccagagggctccccaggatgggtcttttggaggtagatttgatgcccacaacgcatgcaaggctaagacccccaacttagccaacgaagcccatggcctcagaagggctgcagcttgctcaggccgtgggccaggatgcatgctggacggttctccaaataaaaaagccccaagggtttgtctacactgcttacctgctggggctgtgagtggggagacggcggcctgcctagggctcctggtgccaggctcaggaagagtcattcattgcaaagggccggcaagtgaaccagggccacctctgtccccagcctgtgagaggagcagctagccctgagaagggcaaggatgaatgaggctgaccacgtcacaggagtcctccaagagtgacggggattcagtcatcggccacaatggagagggcccggagctcactgagtttggcctcgttctcccgctcccgctgctcatcggagtggcctggctggtc

SEQ ID NO: 116041 - DNA, 3980 bp, Homo sapiens
  Payload ID: 2639
  Gene Symbol: CCAR2
  Gene Name: cell cycle and apoptosis regulator 2
  Uniprot ID: Q8N163
  ENST ID: ENST00000389279
  CDS Start-End: 420-3191
cctcagtcctcccttggtggcctcgccgcggctctgctgggagacccggcgctggcggctgctgaggccggagcggagggcccgggagcgtgggagcaggagggtggcgcgcagccggtttcgcgtttggtcggccagggagctgccttcccaccagccggtcgaggaaacaacgggtcgggcttccggggagagggcccacacagtctcctcgccggcaccggcctcctccatttttccgggccttgcgtggagggttttggcggatgtttttgaacgaaggaatgtcatcggggctctctcgagcccctcaccccgccagctactctgggggtggcgtggcatagtgagaggagcgctaagttgttgggaggcctgggtccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggttttttttttttttttttggcttgttttttaaataaaccaaagtcaaaaacaaa

SEQ ID NO: 116042 - DNA, 2633 bp, Homo sapiens
  Payload ID: 2639
  Gene Symbol: CCAR2
  Gene Name: cell cycle and apoptosis regulator 2
  ENST ID: ENST00000520738
  CDS Start-End: 1-1847
aggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggttttttttttttttttttggcttgttttttaaataaaccaaagtcaaaaac

SEQ ID NO: 116043 - DNA, 542 bp, Homo sapiens
  Payload ID: 2639
  Gene Symbol: CCAR2
  Gene Name: cell cycle and apoptosis regulator 2
  ENST ID: ENST00000523349
  CDS Start-End: 56-542
ttctttttggattgaagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagc

SEQ ID NO: 116044 - DNA, 1107 bp, Homo sapiens
  Payload ID: 2639
  Gene Symbol: CCAR2
  Gene Name: cell cycle and apoptosis regulator 2
  ENST ID: ENST00000522599
  CDS Start-End: 277-1107
taagctttccagaggcttccatcattaatattttatttcctttcagtcttctaaagttgtttttgcagtagctgaggcctactgtgtatacaatgttgcagagtgtgctttttgcttaacaggaatgtttattaaaacagtaaatatccattttaatatctttataacattctgtcatatggctgttagcatggattctttttccatttattgaatgtgagggatttcgattgtttccagttcttttagttcagtttgtattgaatacatataacaatgtggtttcttactgttggtgatgggtcaacctctagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggg

SEQ ID NO: 116045 - DNA, 337 bp, Homo sapiens
  Payload ID: 2639
  Gene Symbol: CCAR2
  Gene Name: cell cycle and apoptosis regulator 2
  ENST ID: ENST00000521301
  CDS Start-End: 91-336
gtggtggttccgggtgtctttgtccccccggtgtcgctgccctggcccgcagccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaaggtagg

SEQ ID NO: 116046 - DNA, 3560 bp, Homo sapiens
  Payload ID: 2639
  Gene Symbol: CCAR2
  Gene Name: cell cycle and apoptosis regulator 2
  ENST ID: ENST00000520861
  CDS Start-End: 696-2492
agtgtggtgaagggccgtctgccccagctgggtgagaaggtgctggtgaaggctgcatacaacccaggccaggcagtgccctggaatgctgtcaaggtgcaaacgctctccaaccagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaagtgatgactatgactccaagaaacgcaaacagcgggctggtggagagccctggggtgctaagaagccaaggcatgacctgcctccttaccgggtccacctcactccttacactgtggacagccccatctgtgacttcctagaactccagcgccgttaccgcagcctcctggtcccctcagattttctgtccgtgcatctgagttggctatcagccttccccctgagccagcccttttccctccatcatccaagccggatccaggtctcttctgaaaaggaggcagctccagacgctggtgctgagcccatcactgcagacagtgaccccgcttatagttcgaaggtactgctgctctcttccccggggttggaggaattgtatcgttgttgcatgctctttgtggatgacatggctgagccaagggagacgccagagcatcctctgaagcagattaagtttttgctgggcaggaaagaagaggaggcagtgctggttgggggtgaatggtctccttccctggatggcctcgacccccaggctgacccgcaggtgctggtgcgtaccgccatccgctgtgcgcaggcccagactggcattgatttgagcggctgtaccaagtggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggtaaggtgggggtggaccaggaggcagcacagctcctttccctgagctccaaaagtccccagaagggcgcttgcccgtgtcgggagtgaccagagggccagcaggcaccggcttcgtctttccatcgcttgccaggcagtgtgcccctggttgcaggttctctgggaattgagcagtcagcagcgtgcagtgggagcttcccagcaggaggcagtccgcagtccgcagtcctcagatcaccttgccaggcccgattctgggtacatcatctgtttcaaacaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggttttttttttttttttttggcttgttttttaaataaaccaaagtcaaaaac

SEQ ID NO: 116047 - DNA, 549 bp, Homo sapiens
  Payload ID: 2639
  Gene Symbol: CCAR2
  Gene Name: cell cycle and apoptosis regulator 2
  ENST ID: ENST00000523801
  CDS Start-End: 1-549
gcttccggtggcggcggcagcagcggctgtggtggttccgggtgtctttgtccccccggtgtcgctgccctggcccgcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgag

SEQ ID NO: 116048 - DNA, 549 bp, Homo sapiens
  Payload ID: 2639
  Gene Symbol: CCAR2
  Gene Name: cell cycle and apoptosis regulator 2
  ENST ID: ENST00000521837
  CDS Start-End: 99-549
gtaaaacagcatgacagtatcatgcaccactaggttattgtcagggcaaactggaacaatccttttccccacgactctgaaagaggacagcgttcccaatgtcccagtttaagcgccagcggatcaacccgcttccagggggacgcaacttctcaggcacagcttcaacatctcttctgggccctcctcctggtttgctcactcctcctgtggccacagaactgtcccagaatgccaggcaccttcagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttcc

SEQ ID NO: 116049 - DNA, 453 bp, Homo sapiens
  Payload ID: 2639
  Gene Symbol: CCAR2
  Gene Name: cell cycle and apoptosis regulator 2
  ENST ID: ENST00000518989
  CDS Start-End: 1-445
cttacagggtggggagaaacagcgggtcttcactggtattgttaccagcttgcatgactactttggggttgtggatgaagaggtcttttttcagctaagtgtggtgaagggccgtctgccccagctgggtgagaaggtgctggtgaaggctgcatacaacccaggccaggcagtgccctggaatgctgtcaaggtgcaaacgctctccaaccagcccctactgaagtccccagcacctcctcttctgcatgtagcagccctgggccagaagcaagggatcctgggagctcagcctcagttgatcttccagcctcaccggattcccccactctttcctcagaagcctctgagtctcttccaaacatcccacacacttcacctgagccacctgaacagatttcctgcccggggccctcatggacggttggatcagggccgaaggtaagaggatga

SEQ ID NO: 116050 - DNA, 1421 bp, Homo sapiens
  Payload ID: 2639
  Gene Symbol: CCAR2
  Gene Name: cell cycle and apoptosis regulator 2
  ENST ID: ENST00000613179
  CDS Start-End: 299-1117
gtgggaggccctgtgccagcagaaagctgcagaggcagctcccccaacccaggaggcacaaggggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagactttgtctgcctcgtagaaggaggatgggcttttgccaaaccactctcttctgggggagaggaagaagaaaaaccccggggcgaggcttctgaggacctgtgtgagatggccctggacccagaactgttgcttctgagggatgatggagaggaggagtttgcaggagcaaagctggaggattcggaggtccggtccgttgcctcaaaccagtcagagatggagttctcttcacttcaggacatgcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggccaagcagctggtcagcagggtggtgacccagaacatctgccagtaccggagccttcagtacagccgccaggagggcctggatggtggccttcccgaggaggtgctcttcggaaacctggacctgctgccccctcctgggaaaagcacgaagccaggttgcccccacagaacacaaagccttggtgtcccacaatggcagcctgattaacgtggggagcctgctgcagcgcgcggagcagcaggacagcggccggctctacctagagaacaagatccacacactggagctgaagctggaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggtaaggtgg

SEQ ID NO: 116051 - DNA, 4108 bp, Homo sapiens
  Payload ID: 2640
  Gene Symbol: CAPRIN1
  Gene Name: cell cycle associated protein 1
  Uniprot ID: Q14444
  ENST ID: ENST00000341394
  CDS Start-End: 190-2319
cagagggctgctggctggctaagtccctcccgctcccggctctcgcctcactaggagcggctctcggtgcagcgggacagggcgaagcggcctgcgcccacggagcgcgcgacactgcccggaagggaccaccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctaggaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgacttt

SEQ ID NO: 116052 - DNA, 3498 bp, Homo sapiens
  Payload ID: 2640
  Gene Symbol: CAPRIN1
  Gene Name: cell cycle associated protein 1
  Uniprot ID: Q14444
  ENST ID: ENST00000389645
  CDS Start-End: 141-2225
actaggagcggctctcggtgcagcgggacagggcgaagcggcctgcgcccacggagcgcgcgacactgcccggaagggaccaccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttaacatttagagaaccatttagaagtgatagaactaatggaatttgcaatgccttttggacctctattagtgatataaatatcaagttatttctgacttttaaacaaaactcccaaattcctaacttattgagctatacttaaaaaaaattacaggtttagagagttttttgtttttcttttactgttggaaaactacttcccattttggcaggaagttaacctatttaacaattagagctagcatttcatgtagtctgaaattctaaatggttctctgatttgagggaggttaaacatcaaacaggtttcctctattggccataacatgtataaaatgtgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttaacagtttaggtaataaggtctgttttcattctggtgcttttattaattttgatagtatgatgttacttactactgaaatgtaagctagagtgtacactagaatgtaagctccatgagagcaggtaccttgtctgtcttctctgctgtatctattcccaacgcttgatgatggtgcctggcacatagtaggcactcaataaatatttgttgaatg

SEQ ID NO: 116053 - DNA, 668 bp, Homo sapiens
  Payload ID: 2640
  Gene Symbol: CAPRIN1
  Gene Name: cell cycle associated protein 1
  ENST ID: ENST00000534825
  CDS Start-End: 109-668
ggaagccggcaaaagccggccctccccggtagggaccgttgcagtggccgttggcggccggcgcggcgatgccccgcctccggcgcgagcctcggagcccccgggctgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttgga

SEQ ID NO: 116054 - DNA, 2266 bp, Homo sapiens
  Payload ID: 2640
  Gene Symbol: CAPRIN1
  Gene Name: cell cycle associated protein 1
  ENST ID: ENST00000529307
  CDS Start-End: 233-2119
gtctctgaggcccgatttctctgacgagggcccaaaatgaagaggtccctgcgcggggggctccgggttcaaccgaccgcctcgtggagttggggcggcctgcgtcctgcagccttggggtctgtccgctcggttaccatgcactcgagacctgtcgagcgtcccctcttcttccgtaggagagaagtgtgtttagaatcttaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactac

SEQ ID NO: 116055 - DNA, 3438 bp, Homo sapiens
  Payload ID: 2640
  Gene Symbol: CAPRIN1
  Gene Name: cell cycle associated protein 1
  Uniprot ID: Q14444
  ENST ID: ENST00000532820
  CDS Start-End: 212-2341
gtgcgaggcccagccgggcgccccgctggcgggtcgcgcgcgcgcccgcgcactcttcctgccctcgaggcgcgccgcgccccctcccccacccgctcgcgtaggctaccgctcgctgcgcgttttgtcccgcgtctcgccccgtccgtctcctgactggccgctcttgtccttcctcccgctttttcttctctctccttgcggtctgaagatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcag

SEQ ID NO: 116056 - DNA, 3454 bp, Homo sapiens
  Payload ID: 2640
  Gene Symbol: CAPRIN1
  Gene Name: cell cycle associated protein 1
  Uniprot ID: Q14444
  ENST ID: ENST00000530820
  CDS Start-End: 93-2177
gcgttttgtcccgcgtctcgccccgtccgtctcctgactggccgctcttgtccttcctcccgctttttcttctctctccttgcggtctgaagatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttaacatttagagaaccatttagaagtgatagaactaatggaatttgcaatgccttttggacctctattagtgatataaatatcaagttatttctgacttttaaacaaaactcccaaattcctaacttattgagctatacttaaaaaaaattacaggtttagagagttttttgtttttcttttactgttggaaaactacttcccattttggcaggaagttaacctatttaacaattagagctagcatttcatgtagtctgaaattctaaatggttctctgatttgagggaggttaaacatcaaacaggtttcctctattggccataacatgtataaaatgtgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttaacagtttaggtaataaggtctgttttcattctggtgcttttattaattttgatagtatgatgttacttactactgaaatgtaagctagagtgtacactagaatgtaagctccatgagagcaggtaccttgtctgtcttctctgctgtatctattcccaacgcttgatgatggtgcctggcacatagtaggcactcaataaatatttgttgaatgaatg

SEQ ID NO: 116057 - DNA, 3266 bp, Homo sapiens
  Payload ID: 2640
  Gene Symbol: CAPRIN1
  Gene Name: cell cycle associated protein 1
  ENST ID: ENST00000618582
  CDS Start-End: 200-2149
cttcctcccgctttttcttctctctccttgcggtctgaagatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcag

SEQ ID NO: 116058 - DNA, 1649 bp, Homo sapiens
  Payload ID: 2641
  Gene Symbol: CEND1
  Gene Name: cell cycle exit and neuronal differentiation 1
  Uniprot ID: Q8N111
  ENST ID: ENST00000330106
  CDS Start-End: 177-626
agtgcattgtgggaaactcccgagctctcctccgcgttcgcagccgccgtcatcccgcggaggagcgcgcagccccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccccacggtccccagcagtcccgatgcaaccccggagcccaagggtcctggggacggggcggaggaagatgaggctgccagtggggggcctgggggccgaggtccctggtcctgtgagaacttcaaccccctgctggtggctgggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggcacagctggggaacggcaagaaaggaatggaccctgtgtgtggccccccccacccctggcggctgggtgatcctgggcccccagggctggtctgagtgcaggtgggggtgccgggatgggttgggcctgggcccggccctcgtggggacattaaagggcgcggtggctccactcgccccatttctgctctttgcgtaccccccgggggtctgcctgggcgaatgcagtgggacggacctggggtgggcactcacctcagcagagcctcaatgccacctccccacaccacccaagcctagctgggtgggaagacggagccctgaagcctgcgtgtggagggggtgctgcccaagggtcgccttccccagcttgtgctccaggggagccccgacgccggcggggaggcagggatgtcgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactggccagtggccacaggaaccccgggcctgagtggaggctgagtctgaaataaactctgtcgtctgaaggctgctcttg

SEQ ID NO: 116059 - DNA, 6822 bp, Homo sapiens
  Payload ID: 2642
  Gene Symbol: CCPG1
  Gene Name: cell cycle progression 1
  Uniprot ID: Q9ULG6
  ENST ID: ENST00000310958
  CDS Start-End: 300-2573
ggatgttgtggggatctgcggccgcctggcccagcttcccgcagccgcccggcggcggcctgcgctccacttcgggagtggtagttcttctcttcaccgctgccgggcaggaggcgcaggcgggactacgcgtcacggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccttggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctttatattctgtaacatgaaacttacctaatcttcaaatgttagcttcattttttacctttgaaatacttaatctttctgaataaatataatgtgtctataaaataatgagactgattctggtgtctttagtcattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttaatcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatcttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaggagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggcta

SEQ ID NO: 116060 - DNA, 3453 bp, Homo sapiens
  Payload ID: 2642
  Gene Symbol: CCPG1
  Gene Name: cell cycle progression 1
  Uniprot ID: Q9ULG6
  ENST ID: ENST00000442196
  CDS Start-End: 49-2472
agccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccttggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctga

SEQ ID NO: 116061 - DNA, 1945 bp, Homo sapiens
  Payload ID: 2642
  Gene Symbol: CCPG1
  Gene Name: cell cycle progression 1
  Uniprot ID: Q9ULG6
  ENST ID: ENST00000425574
  CDS Start-End: 96-1370
ataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagaaagctcttcactgactttgttaatgatgttaaagattatcttagaaacatgaaggaatatgaagtagataatgatggagtatttgagaagttggatgaatatatatatagacacttctttggtcacactttttcccctccatatggacccagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgag

SEQ ID NO: 116062 - DNA, 2970 bp, Homo sapiens
  Payload ID: 2642
  Gene Symbol: CCPG1
  Gene Name: cell cycle progression 1
  Uniprot ID: Q9ULG6
  ENST ID: ENST00000569205
  CDS Start-End: 216-2489
tcctcgggccgtgcgcgagtgcacagctccggaggcccgagccgaccctggggcgtccggtccggtggtcttgcagcctccaaaccccgagtgctataccgaactgcgcgccaagggtgggagagctgacggcctgggccacccttcttccttcactgggcaggctttgaggtgcttgtcggtctggactgatgaaaatccatatgacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccttggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagagg

SEQ ID NO: 116063 - DNA, 702 bp, Homo sapiens
  Payload ID: 2642
  Gene Symbol: CCPG1
  Gene Name: cell cycle progression 1
  ENST ID: ENST00000568592
  CDS Start-End: 1-610
gaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgac

SEQ ID NO: 116064 - DNA, 790 bp, Homo sapiens
  Payload ID: 2642
  Gene Symbol: CCPG1
  Gene Name: cell cycle progression 1
  ENST ID: ENST00000563171
  CDS Start-End: 69-790
gtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgaaaggtggtgggagaagctgtggaagattcctgagtgcatatggggatgggatgatcagctgaaacaccatgttcctagccaactcgctttccaagtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacg

SEQ ID NO: 116065 - DNA, 721 bp, Homo sapiens
  Payload ID: 2642
  Gene Symbol: CCPG1
  Gene Name: cell cycle progression 1
  ENST ID: ENST00000568543
  CDS Start-End: 1-98
tcagaaagatacatgaagatgaattgaatgatatgaaggattatctttcccagtgtcaacaggaacaagaatcttttatagattataagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgt

SEQ ID NO: 116066 - DNA, 2866 bp, Homo sapiens
  Payload ID: 2642
  Gene Symbol: CCPG1
  Gene Name: cell cycle progression 1
  ENST ID: ENST00000568808
  CDS Start-End: 69-527
gtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatgtcattgaaagaaaatcttgcaaggtgttggacacttactgaagcagagaagatgtcctttgaaactcagaaaacgaaccttgctacagaaaatcagtatttaagagtatccttggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctttatattctgtaacatgaaacttacctaatcttcaaatgttagcttcattttttacctttgaaatacttaatctttctgaataaatataatgtgtctataaaataa

SEQ ID NO: 116067 - DNA, 578 bp, Homo sapiens
  Payload ID: 2642
  Gene Symbol: CCPG1
  Gene Name: cell cycle progression 1
  ENST ID: ENST00000564092
  CDS Start-End: 303-578
atgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagagatgggtcttcaccatgttgcccaggctggtctcaaactcgtgagttcaagcgatttgcctgccttggcctcccaaagtattggaattacagacgtgagccaacgggcccggcctgtggcttttcgtggagttcttagaacacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaa

SEQ ID NO: 116068 - DNA, 570 bp, Homo sapiens
  Payload ID: 2642
  Gene Symbol: CCPG1
  Gene Name: cell cycle progression 1
  ENST ID: ENST00000570272
  CDS Start-End: 59-570
atagtaaaatgtagctacccaggaatgatgaggggcaccatcatatcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcc

SEQ ID NO: 116069 - DNA, 663 bp, Homo sapiens
  Payload ID: 2642
  Gene Symbol: CCPG1
  Gene Name: cell cycle progression 1
  ENST ID: ENST00000564663
  CDS Start-End: 1-352
cactgactttgttaatgatgttaaagattatcttagaaacatgaaggaatatgaagtagataatgatggagtatttgagaagttggatgaatatatatatagacacttctttggtcacactttttcccctccatatggacccagtcgacctgataaaaagcaacgtatggtaaatattgaaaactccaggcatcgaaaacaagagcagaagcaccttcagccacagccttataaaagggaagatggagtcttgctctgtcgcccaggctggagtgcagtggcgcgatctcggctcactgcaagctccgcctcgcgggttcacgccattctcctgcctcagcctcccgagtagctgggactacaggcgcccgctaccacgcccggctaattttttctatttttagtagagacggggtttcaccatgttagccaggatggtctcaatctcctgacctcgtgatctgcctgcctcggcctcccaaagtgctgcgattataggtgtgagccaccatgcctggcctaataattttaattaatgactgtatgaaatccttcttaactgttattttttcttctttaagtattaatgtgttccttgttaatttgtaaaactagatttttgagattcaaagtgagaatcaaacttatattttggcagtctaa

SEQ ID NO: 116070 - DNA, 828 bp, Homo sapiens
  Payload ID: 2643
  Gene Symbol: CIDEA
  Gene Name: cell death-inducing DFFA-like effector a
  Uniprot ID: O60543
  ENST ID: ENST00000320477
  CDS Start-End: 66-725
ggccgccgcactttaagaggctgtgcaggcagacagacctccaggcccgctaggggatccgcgccatggaggccgcccgggactatgcaggagccctcatcaggcccctgacatttatgggatcacagactaagcgagtcctgttcaccccgctcatgcatccagctcgccctttccgggtctccaaccatgacaggagcagccggcgtggggtgatggcaagcagcctgcaggagctcatcagcaagactctggatgccctcgtcatcgctaccggactggtcactctggtgctggaggaagatggcaccgtggtggacacagaagagttctttcagaccttgggagacaacacgcatttcatgatcttggaaaaaggacagaagtggatgccgggcagccagcacgtccccacttgctcgccgccgaagaggtcgggaatagcgagagtcaccttcgacttgtacaggctgaaccccaaggacttcatcggctgccttaacgtgaaggccaccatgtatgagatgtactccgtgtcctacgacatccggtgcacgggactcaagggcctgctgaggagtctgctgcggttcctgtcctactccgcccaggtgacgggacagtttctcatctatctgggcacatacatgctccgggtgctggatgacaaggaagagcggccatccctccggtcacaagccaagggcaggttcacgtgtggatagggatgcaggctgtcgccggctcttgagccaaacactgtgtttcgtttggctcaatgacgaatgttgaagatgcttttatgttctgagccacatgcacttggag

SEQ ID NO: 116071 - DNA, 1808 bp, Homo sapiens
  Payload ID: 2643
  Gene Symbol: CIDEA
  Gene Name: cell death-inducing DFFA-like effector a
  ENST ID: ENST00000522713
  CDS Start-End: 24-626
aggcccgctaggggatccgcgccatggaggccgcccgggactatgcaggagccctcatcaggcgagtgccccgcgtccccctgattgccgtgcgcttccaatcgccttgcgttcggtggcctcatattcccctgtgcgcctctagtaccgtaccccgctcccttcagccccctgctccccgcattctcttgcgctccgcgaccccgcgcacacacccatccgccccactggtgcccaagccgtccagccgcgcccgcgggcagagcccaatcccgtcccgcgcctcctcaccctcttgcagctgggcacaggtaccaggtgtggctcttgcgaggtgcgcgggcgtctgcaaaccaggtgacagctggcgagtggctgcatgcatctctggccgctgctgcagtcgcgggcgcagaagagggtccggtcccaggaaccccgagcaaagcttccgcgatgcgaggggaccgggcttctgggggtcctggaaatcacaacgggagctgggcgcgggaggggcccaggcttggcccctcctggaagcgcgggctctggtctccgaggggaggccccaaccgtccggcggagccctccaggcccctgacatttatgggatcacagactaagcgagtcctgttcaccccgctcatgcatccagctcgccctttccgggtctccaaccatgacaggagcagccggcgtggggtgatggcaagcagcctgcaggagctcatcagcaagggaggatgcagggatggagccgactttggaagtctgggtttggttgtaaaggccaggatctagaacagtgtcctagaccaccaaataaggaagaatcccagcctctcagagaagcataactcagactcaggcacccatggaaacaagaaacaagcatccaacatgcagtctctgaagcaagagagacactcagctacgcacacgaggctgtggctcttacagcagcaaacatgcaagagctttctttttattcatctaaataaatagactctggatgccctcgtcatcgctaccggactggtcactctggtgctggaggaagatggcaccgtggtggacacagaagagttctttcagaccttgggagacaacacgcatttcatgatcttggaaaaaggacagaagtggatgccgggcagccagcacgtccccacttgctcgccgccgaagaggtcgggaatagcgagagtcaccttcgacttgtacaggctgaaccccaaggacttcatcggctgccttaacgtgaaggccaccatgtatgagatgtactccgtgtcctacgacatccggtgcacgggactcaagggcctgctgaggagtctgctgcggttcctgtcctactccgcccaggtgacgggacagtttctcatctatctgggcacatacatgctccgggtgctggatgacaaggaagagcggccatccctccggtcacaagccaagggcaggttcacgtgtggatagggatgcaggctgtcgccggctcttgagccaaacactgtgtttcgtttggctcaatgacgaatgttgaagatgcttttatgttctgagccacatgcacttggaggccgctggtcacgctgctcaggagtggtgcccagaaaaggaaagggcttggtggtacatgaagtgggggcagtgggcagggtgccctgggggggaggcatagagggccctgggggtcatgggaagcgagcacgcagcaggcgtgcccaggagcgtgtgcatgtgtcagagccatttggtccatcatctcctgcaataaacccatcgcaagaatgaccttc

SEQ ID NO: 116072 - DNA, 2294 bp, Homo sapiens
  Payload ID: 2644
  Gene Symbol: CIDEB
  Gene Name: cell death-inducing DFFA-like effector b
  Uniprot ID: Q9UHD4
  ENST ID: ENST00000258807
  CDS Start-End: 1189-1848
gccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacaggacacagaaaaaaagtggggaagctgggggaccctacaaggatccttggcaggaaagcagggattgtgttcatttgagggtttcactgtcagtgagagtctcagcttccatgcaactgtccatcacggctgcaactgaaatcagagctgggacacagcgcaccagaagctaaagtcttgatgccatcaaaggacatccctgccccattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaa

SEQ ID NO: 116073 - DNA, 2409 bp, Homo sapiens
  Payload ID: 2644
  Gene Symbol: CIDEB
  Gene Name: cell death-inducing DFFA-like effector b
  Uniprot ID: Q9UHD4
  ENST ID: ENST00000336557
  CDS Start-End: 1304-1963
ttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacagcctgcctcttttctgcctgggagtcctgacttccacgaggacccagaccccacctcaaacacaactccttcttggaacccagatcccctgctcccagtcagttgacctgccccactcctggcctccttcccagagctcagtggacacagaaaaaaagtggggaagctgggggaccctacaaggatccttggcaggaaagcagggattgtgttcatttgagggtttcactgtcagtgagagtctcagcttccatgcaactgtccatcacggctgcaactgaaatcagagctgggacacagcgcaccagaagctaaagtcttgatgccatcaaaggacatccctgccccattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaa

SEQ ID NO: 116074 - DNA, 1602 bp, Homo sapiens
  Payload ID: 2644
  Gene Symbol: CIDEB
  Gene Name: cell death-inducing DFFA-like effector b
  Uniprot ID: Q9UHD4
  ENST ID: ENST00000554411
  CDS Start-End: 406-1065
gagccactcataaactgcagcttctcagagcctgagagccagaaaccgtccccagaaattccctccatagaaataaaaaaacaccagaagtcacatttcatccttttacatggttcccatctaccctcacaacacatgtcatcaccaaagacacacatacaagctccaatggcttttgccaggcaattcttcctccaggaccccatctggcccctccctcatccctccccttggactttgcccttcttactggccaggcaggggggccagagtccaggcttgactcattcccaccttgtcctgggctgagatcccaggtttgtaacagaaaacaccactaaagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaagacttctgactccaatttaaaccaggaaagggatggggtggataccccattttgccctcccccatcaacacccagtcccagatccaaagcc

SEQ ID NO: 116075 - DNA, 248 bp, Homo sapiens
  Payload ID: 2644
  Gene Symbol: CIDEB
  Gene Name: cell death-inducing DFFA-like effector b
  ENST ID: ENST00000556756
  CDS Start-End: 1-184
agtggacagtgaggacttcttccagctgctggaggatgacacgtgcctgatggtgttgcagtctggtcagagctggagccctacaaggggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaat

SEQ ID NO: 116076 - DNA, 1277 bp, Homo sapiens
  Payload ID: 2645
  Gene Symbol: CIDEC
  Gene Name: cell death-inducing DFFA-like effector c
  Uniprot ID: Q96AQ7
  ENST ID: ENST00000336832
  CDS Start-End: 141-857
agaatgttcttttggccactgtgaagcctcaggaaggggctcggattgctcaaggacccatgggagagaggaggctttgactgggctgcctgcctgtgaggtctctggactagaggtccaacgcagtccagctgacaaggatggaatacgccatgaagtcccttagccttctctaccccaagtccctctccaggcatgtgtcagtgcgtacctctgtggtgacccagcagctgctgtcggagcccagccccaaggcccccagggcccggccctgccgcgtaagcacggcggatcgaagcgtgaggaagggcatcatggcttacagtcttgaggacctcctcctcaaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctga

SEQ ID NO: 116077 - DNA, 1199 bp, Homo sapiens
  Payload ID: 2645
  Gene Symbol: CIDEC
  Gene Name: cell death-inducing DFFA-like effector c
  ENST ID: ENST00000383817
  CDS Start-End: 21-776
agtgtgaccagagccaggggatgagaaacatggagtccaacgcagtccagctgacaaggatggaatacgccatgaagtcccttagccttctctaccccaagtccctctccaggcatgtgtcagtgcgtacctctgtggtgacccagcagctgctgtcggagcccagccccaaggcccccagggcccggccctgccgcgtaagcacggcggatcgaagcgtgaggaagggcatcatggcttacagtcttgaggacctcctcctcaaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctgatgt

SEQ ID NO: 116078 - DNA, 1123 bp, Homo sapiens
  Payload ID: 2645
  Gene Symbol: CIDEC
  Gene Name: cell death-inducing DFFA-like effector c
  Uniprot ID: Q96AQ7
  ENST ID: ENST00000455015
  CDS Start-End: 209-703
agaatgttcttttggccactgtgaagcctcaggaaggggctcggattgctcaaggacccatgggagagaggaggctttgactgggctgcctgcctgtgaggtctctggactagaggtccaacgcagtccagctgacaaggatggaatacgccatgaagtcccttagccttctctaccccaagtccctctccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctga

SEQ ID NO: 116079 - DNA, 1036 bp, Homo sapiens
  Payload ID: 2645
  Gene Symbol: CIDEC
  Gene Name: cell death-inducing DFFA-like effector c
  Uniprot ID: Q96AQ7
  ENST ID: ENST00000423850
  CDS Start-End: 122-616
agtatttccaggaggctgtgagggggaggtccaacgcagtccagctgacaaggatggaatacgccatgaagtcccttagccttctctaccccaagtccctctccaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctga

SEQ ID NO: 116080 - DNA, 877 bp, Homo sapiens
  Payload ID: 2645
  Gene Symbol: CIDEC
  Gene Name: cell death-inducing DFFA-like effector c
  Uniprot ID: Q96AQ7
  ENST ID: ENST00000430427
  CDS Start-End: 26-772
gtccaacgcagtccagctgacaaggatggaatacgccatgaagtcccttagccttctctaccccaagtccctctccaggcatgtgtcagtgcgtacctctgtggtgacccagcagctgctgtcggagcccagccccaaggcccccagggcccggccctgccgcgtaagcacggcggatcgaagcgtgaggaagggcatcatggcttacagtcttgaggacctcctcctcaagactaggaaccctgaagccaggagccaagaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccc

SEQ ID NO: 116081 - DNA, 443 bp, Homo sapiens
  Payload ID: 2645
  Gene Symbol: CIDEC
  Gene Name: cell death-inducing DFFA-like effector c
  ENST ID: ENST00000443115
  CDS Start-End: 3-404
ggatggaatacgccatgaagtcccttagccttctctaccccaagtccctctccaggcatgtgtcagtgcgtacctctgtggtgacccagcagctgctgtcggagcccagccccaaggcccccagggcccggccctgccgcgtaagcacggcggatcgaagcgtgaggaagggcatcatggcttacagtcttgaggacctcctcctcaagggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgccc

SEQ ID NO: 116082 - DNA, 1226 bp, Homo sapiens
  Payload ID: 2645
  Gene Symbol: CIDEC
  Gene Name: cell death-inducing DFFA-like effector c
  Uniprot ID: Q96AQ7
  ENST ID: ENST00000618572
  CDS Start-End: 57-803
ggcagtatttccaggaggctgtgagggggaggtccaacgcagtccagctgacaaggatggaatacgccatgaagtcccttagccttctctaccccaagtccctctccaggcatgtgtcagtgcgtacctctgtggtgacccagcagctgctgtcggagcccagccccaaggcccccagggcccggccctgccgcgtaagcacggcggatcgaagcgtgaggaagggcatcatggcttacagtcttgaggacctcctcctcaagactaggaaccctgaagccaggagccaagaggtccgggacactctgatgctggcagacaagcccttcttcctggtgctggaggaagatggcacaactgtagagacagaagagtacttccaagccctggcaggggatacagtgttcatggtcctccagaaggggcagaaatggcagcccccatcagaacaggggacaaggcacccactgtccctctcccataagcctgccaagaagattgatgtggcccgtgtaacgtttgatctgtacaagctgaacccacaggacttcattggctgcctgaacgtgaaggcgactttttatgatacatactccctttcctatgatctgcactgctgtggggccaagcgcatcatgaaggaagctttccgctgggccctcttcagcatgcaggccacaggccacgtactgcttggcacctcctgttacctgcagcagctcctcgatgctacggaggaagggcagccccccaagggcaaggcctcatcccttatcccgacctgtctgaagatactgcagtgaaagcccaagtccttggaagctttccccagtgaaggactgactgggggcctcacgcttaactggtagtgcccacaagcctggcagctgtagagccgcgaacctccccacacctccctcaccgcgcaggaccctgagtgaggaggaggagctggaaacctggggtgggttggccaaaggagaacctcaagctcctggcctgatccagctccttcctgcccaaggcagcttagcccatccagactggtcctgaagtctgtccctccattggcatgaagtctgccccttagcaatctggcctcgcaggctgtactttcatggtgctctctaccttctggcccccatcccggaacattcctgagtgaattcgcaagcgcactagcatgtgatattagggagtttgcaataaattattgaggctgatgt

SEQ ID NO: 116083 - DNA, 3009 bp, Homo sapiens
  Payload ID: 2646
  Gene Symbol: CDIP1
  Gene Name: cell death-inducing p53 target 1
  Uniprot ID: Q9H305
  ENST ID: ENST00000399599
  CDS Start-End: 550-1176
gatgctaagtaagagcaaaagcttcccacctttctgagctgtgctcagagagtttggtgacagaaatgagggaaaagatttcacttgactcttcttccccctgacccccacctcaacaaacaaaccagaagggcacaggccagagcacagcttgcctggcagtccagtcctcatgcatgggagctcaggcctggtgggaggggaggcagagggcccagccgtggcccttgggtgccagcagtcctgggggagggaggaagcagacctgcgacgggaccgaggaatggaggggtggtcgggtgtgtggatggcagagtgacagctagggagaagccggatgtggaaggggaggaactgtgtggtatgcccaggcccctgggcccagccctggcttggcagcccttgctccctgctgagggccctgcctttccttcccctgaaacagctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaacacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggta

SEQ ID NO: 116084 - DNA, 2774 bp, Homo sapiens
  Payload ID: 2646
  Gene Symbol: CDIP1
  Gene Name: cell death-inducing p53 target 1
  Uniprot ID: Q9H305
  ENST ID: ENST00000563332
  CDS Start-End: 251-877
ctctgggcggtggggtgggcggtgggttggggggtttcgttgtgcgcgcaaagccgcgcggggctgagggtcttgttctgccggcgcctgtccggacccgggcccctctccgctttcggccggcctcgggcaccgggcttctggagctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaacacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttcatgtttctcttttagagaatgaattgtttaaa

SEQ ID NO: 116085 - DNA, 1205 bp, Homo sapiens
  Payload ID: 2646
  Gene Symbol: CDIP1
  Gene Name: cell death-inducing p53 target 1
  Uniprot ID: Q9H305
  ENST ID: ENST00000562334
  CDS Start-End: 177-566
agaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctg

SEQ ID NO: 116086 - DNA, 1463 bp, Homo sapiens
  Payload ID: 2646
  Gene Symbol: CDIP1
  Gene Name: cell death-inducing p53 target 1
  Uniprot ID: Q9H305
  ENST ID: ENST00000563507
  CDS Start-End: 188-697
ctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgct

SEQ ID NO: 116087 - DNA, 1636 bp, Homo sapiens
  Payload ID: 2646
  Gene Symbol: CDIP1
  Gene Name: cell death-inducing p53 target 1
  ENST ID: ENST00000564828
  CDS Start-End: 238-396
accgtgacgtcccgggcctcggccctggtccaaagtctacccgcctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcct

SEQ ID NO: 116088 - DNA, 577 bp, Homo sapiens
  Payload ID: 2646
  Gene Symbol: CDIP1
  Gene Name: cell death-inducing p53 target 1
  ENST ID: ENST00000562579
  CDS Start-End: 179-577
acagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccggctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccct

SEQ ID NO: 116089 - DNA, 444 bp, Homo sapiens
  Payload ID: 2646
  Gene Symbol: CDIP1
  Gene Name: cell death-inducing p53 target 1
  ENST ID: ENST00000563186
  CDS Start-End: 111-444
ctcccggagccctgcctgttccctgtccatccaggccagcagctgaaggagcctcacctgcctcccttctctgagtagcacggatttgaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagc

SEQ ID NO: 116090 - DNA, 2062 bp, Homo sapiens
  Payload ID: 2646
  Gene Symbol: CDIP1
  Gene Name: cell death-inducing p53 target 1
  Uniprot ID: Q9H305
  ENST ID: ENST00000567695
  CDS Start-End: 188-814
ctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgc

SEQ ID NO: 116091 - DNA, 484 bp, Homo sapiens
  Payload ID: 2646
  Gene Symbol: CDIP1
  Gene Name: cell death-inducing p53 target 1
  ENST ID: ENST00000588381
  CDS Start-End: 200-484
tctgggcggtggggtgggcggtgggttggggggtttcgttgtgcgcgcaaagccgcgcggggctgagggtcttgttctgccggcgcctgtccggacccgggcccctctccgctttcggccggcctcgggcaccgggcttctggagctcccggagccctgcctgttccctgtccatccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcaggga

SEQ ID NO: 116092 - DNA, 476 bp, Homo sapiens
  Payload ID: 2646
  Gene Symbol: CDIP1
  Gene Name: cell death-inducing p53 target 1
  ENST ID: ENST00000589890
  CDS Start-End: 20-476
tccaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccggggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgct

SEQ ID NO: 116093 - DNA, 838 bp, Homo sapiens
  Payload ID: 2646
  Gene Symbol: CDIP1
  Gene Name: cell death-inducing p53 target 1
  ENST ID: ENST00000589159
  CDS Start-End: 210-477
ctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccggggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaa

SEQ ID NO: 116094 - DNA, 299 bp, Homo sapiens
  Payload ID: 2646
  Gene Symbol: CDIP1
  Gene Name: cell death-inducing p53 target 1
  ENST ID: ENST00000566234
  CDS Start-End: 214-299
agcaaagcagaaagccctgttcctggctggatgcctgggacctgcctcctggggacagaggagcccctctgaggccagctggcgtcctgacgccatggctgccacgtggctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccagg

SEQ ID NO: 116095 - DNA, 756 bp, Homo sapiens
  Payload ID: 2646
  Gene Symbol: CDIP1
  Gene Name: cell death-inducing p53 target 1
  ENST ID: ENST00000586728
  CDS Start-End: 514-756
agggtcttgttctgccggcgcctgtccggacccgggcccctctccgctttcggccggcctcgggcaccgggcttctggagagatggcatgtcattattttgcccagctggtctctaactcctgggctcaagtgatcctcttgcctcaccctcccaaagtgctgggattacaggcaggagctaccgtgcccaagttcttacaaggatttaagagcagccagccgtggttctagaatcaccataagagcagaacattgactgtatgatgtaaagtaatacttcagggaacaaaattgttttgagaaggagctaacggaatgcgtcccgaaggccagcttgccccagcagatcacgttggcaataattgaagctagtcatcagcttgcaactccctgtcggctctttacactctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggt

SEQ ID NO: 116096 - DNA, 3009 bp, Homo sapiens; identical to SEQ ID NO: 116083
  Payload ID: 2646
  Gene Symbol: CDIP1
  Gene Name: cell death-inducing p53 target 1
  Uniprot ID: Q9H305
  ENST ID: ENST00000611166
  CDS Start-End: 550-1176

SEQ ID NO: 116097 - DNA, 838 bp, Homo sapiens; identical to SEQ ID NO: 116093
  Payload ID: 2646
  Gene Symbol: CDIP1
  Gene Name: cell death-inducing p53 target 1
  ENST ID: ENST00000634209
  CDS Start-End: 210-477

SEQ ID NO: 116098 - DNA, 1380 bp, Homo sapiens
  Payload ID: 2646
  Gene Symbol: CDIP1
  Gene Name: cell death-inducing p53 target 1
  Uniprot ID: Q9H305
  ENST ID: ENST00000633324
  CDS Start-End: 105-614
ctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgct

SEQ ID NO: 116099 - DNA, 503 bp, Homo sapiens
  Payload ID: 2646
  Gene Symbol: CDIP1
  Gene Name: cell death-inducing p53 target 1
  ENST ID: ENST00000631926
  CDS Start-End: 105-503
ctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccggctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccct

SEQ ID NO: 116100 - DNA, 1979 bp, Homo sapiens
  Payload ID: 2646
  Gene Symbol: CDIP1
  Gene Name: cell death-inducing p53 target 1
  Uniprot ID: Q9H305
  ENST ID: ENST00000632937
  CDS Start-End: 105-731
ctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgc

SEQ ID NO: 116101 - DNA, 347 bp, Homo sapiens
  Payload ID: 2646
  Gene Symbol: CDIP1
  Gene Name: cell death-inducing p53 target 1
  ENST ID: ENST00000633564
  CDS Start-End: 105-347
ctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggt

SEQ ID NO: 116102 - DNA, 299 bp, Homo sapiens; identical to SEQ ID NO: 116094
  Payload ID: 2646
  Gene Symbol: CDIP1
  Gene Name: cell death-inducing p53 target 1
  ENST ID: ENST00000632367
  CDS Start-End: 214-299

SEQ ID NO: 116103 - DNA, 444 bp, Homo sapiens; identical to SEQ ID NO: 116089
  Payload ID: 2646
  Gene Symbol: CDIP1
  Gene Name: cell death-inducing p53 target 1
  ENST ID: ENST00000634168
  CDS Start-End: 111-444

SEQ ID NO: 116104 - DNA, 476 bp, Homo sapiens; identical to SEQ ID NO: 116092
  Payload ID: 2646
  Gene Symbol: CDIP1
  Gene Name: cell death-inducing p53 target 1
  ENST ID: ENST00000632554
  CDS Start-End: 20-476

SEQ ID NO: 116105 - DNA, 2628 bp, Homo sapiens
  Payload ID: 2646
  Gene Symbol: CDIP1
  Gene Name: cell death-inducing p53 target 1
  Uniprot ID: Q9H305
  ENST ID: ENST00000632680
  CDS Start-End: 105-731
ctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaacacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttcatgtttctcttttagagaatgaattgtttaaa

SEQ ID NO: 116106 - DNA, 1509 bp, Homo sapiens
  Payload ID: 2646
  Gene Symbol: CDIP1
  Gene Name: cell death-inducing p53 target 1
  ENST ID: ENST00000633395
  CDS Start-End: 111-269
ctcccggagccctgcctgttccctgtccatccaggccagcagctgaaggagcctcacctgcctcccttctctgagtagcacggatttgaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcct

SEQ ID NO: 116107 - DNA, 339 bp, Homo sapiens
  Payload ID: 2646
  Gene Symbol: CDIP1
  Gene Name: cell death-inducing p53 target 1
  ENST ID: ENST00000633690
  CDS Start-End: 55-339
ctcccggagccctgcctgttccctgtccatccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcaggga

SEQ ID NO: 116108 - DNA, 1133 bp, Homo sapiens
  Payload ID: 2646
  Gene Symbol: CDIP1
  Gene Name: cell death-inducing p53 target 1
  Uniprot ID: Q9H305
  ENST ID: ENST00000631859
  CDS Start-End: 105-494
ctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctg

SEQ ID NO: 116109 - DNA, 1542 bp, Homo sapiens
  Payload ID: 2647
  Gene Symbol: CDC123
  Gene Name: cell division cycle 123
  Uniprot ID: O75794
  ENST ID: ENST00000281141
  CDS Start-End: 281-1291
tgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtactggaactggagaagaggaggccccgccccaccgctccgggagctgctcatcagccgcaacttcctgccgaccctgatgcgggtgggccgagcagtgtggacatcagccactttttatattcatgtacattcacctggggaaaaaaacggagggactttgctacttgtaaaaataacataataaatagatcttaaacataggaaaaccatactgttctgataataaaatgctttctatgaaat

SEQ ID NO: 116110 - DNA, 933 bp, Homo sapiens
  Payload ID: 2647
  Gene Symbol: CDC123
  Gene Name: cell division cycle 123
  ENST ID: ENST00000378900
  CDS Start-End: 24-911
gcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattgttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtactggaactggagaa

SEQ ID NO: 116111 - DNA, 685 bp, Homo sapiens
  Payload ID: 2647
  Gene Symbol: CDC123
  Gene Name: cell division cycle 123
  ENST ID: ENST00000440613
  CDS Start-End: 1-433
gtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcagaagagaaatcagcaggaggacgactgatgagcgtactggaactggagaagaggaggccccgccccaccgctccgggagctgctcatcagccgcaacttcctgccgaccctgatgcgggtgggccgagcagtgtggacatcagccactttttatattcatgtacattcacctggggaaaaaaacggagggactttgctacttgtaaaaataacataataaatagatcttaaacataggaaaaccatactgttctgataataaaatgctttctatgaaata

SEQ ID NO: 116112 - DNA, 564 bp, Homo sapiens
  Payload ID: 2647
  Gene Symbol: CDC123
  Gene Name: cell division cycle 123
  ENST ID: ENST00000442050
  CDS Start-End: 15-564
gcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagact

SEQ ID NO: 116113 - DNA, 646 bp, Homo sapiens
  Payload ID: 2647
  Gene Symbol: CDC123
  Gene Name: cell division cycle 123
  ENST ID: ENST00000429258
  CDS Start-End: 176-646
gtgcgtttagggcgaagacggagttgtaaacttcttaaaattcctctctcgacacttcgggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagat

SEQ ID NO: 116114 - DNA, 4137 bp, Homo sapiens
  Payload ID: 2648
  Gene Symbol: CDC14A
  Gene Name: cell division cycle 14A
  Uniprot ID: Q9UNH5
  ENST ID: ENST00000336454
  CDS Start-End: 356-2140
atcactttggaagccgggggaagactttgccctgccctgagagctggtctgcgtttcccaggcgcggcggcggcggagcagcagctgcagcagccgagtccaaataggagcggccacagccaggggcgtgagcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacttcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttcccttcagtctgaatatgttcattactaaggccttgccactccagtgaaagctgttcttctcttagacacaatttcttcatctggacgagcagtggagagggaaagcaacttcttgctggaagaatatctctgccttcttaccttaaattaaaaagagcactaagataacaccttcaagagacttgaaaacagaaaactggttaatgactactataaatgcactgaaactatgtttatggagatttccatacttttaaagacagttttaatgttgaatttggtattttgaagggttatttttaatgtattttggtaatacatttattattatatttacatgtacagtgttacattatatatgtattgtgaactttaaaagactattttgataaatttataaatatataaaattatgtaaaaactacactatattttgatttagattttcctgctgtttgctaccaaaaatttgtattttaaatctgtttagttttagtatggttttgtctctaatgaataaataattccttcttattaagaagaagtaagggagaaagtttttagaaagtgatttttatgctcgcactataaatatggcaggtcagttcattcttttgggaagtcagtttagttacactgagtttatccaagtttatctctaccaagagtataatggcatgggatggcttatttaggacaattccctttcctattgtttttgttgctgagccaatttgagttagttttgcatcctggggggctttaaaatacagcatgcagtgaaagatcagaattcactgaatatttcttctgagagcatggtttcatggtttttctctatgaaatgactcaatattccaaatgtttttttttccttcctcctttcaaaagagttcttaacccaattaggatatcctgctttgggtatgaggttgttgttgcctgtaatcacacatggtttgacatcagttttaaatcaatggagagaaaaaactgaaaaagatgctgctaagtagttctctgtattaaaggagatatttttaaaacagggtacaaccccctgctgcacacgctagcatatctggaacctactatgaaaatgaaaggacccttataggtactcacagccctttcatgtaagtatgatctgatatttaggtcttcagaagcctgtaggtttcatttctatgaggaatcgaggagcgttacatcctgatatccttccaggctgcttaagaatggactgcttcgacactgaaagtgctagttaaatggattcatatgaagtgctttactcccaaccattgagttatttataatgtatttattaggggagggtaccttgagtctattatatatgcttcatcaaaacatcttgttcatgttttatgtttttaaaaaaggcatttgaatgaatgtttgactcaggtttgttaaattaaccttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagtatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaattttactctgataataaaaattgtttgacatgtattttgttatgaatagtttatcttccaaaagatattttgctctattttaaagtgtagaagaatacactgctaataaataataaaagttttattcaattta

SEQ ID NO: 116115 - DNA, 2417 bp, Homo sapiens
  Payload ID: 2648
  Gene Symbol: CDC14A
  Gene Name: cell division cycle 14A
  Uniprot ID: Q9UNH5
  ENST ID: ENST00000361544
  CDS Start-End: 465-2336
cgaaggaggatccggagcagctgctgccagcccgcgggcactgaagtcctcccggctgccgctcgagtagccacgggcgcgatcgggaccagaagtctcctcctccatgatcactttggaagccgggggaagactttgccctgccctgagagctggtctgcgtttcccaggcgcggcggcggcggagcagcagctgcagcagccgagtccaaataggagcggccacagccaggggcgtgagcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacttcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatccctgtaagtgcgcagacaccacctcctggtcctcagaaccctgaatgcaacttctgtgccttgccttcccagccgaggctgccaccaaagaaatttaatagtgccaaggaagccttctgagcgatgccttccctctgtgctgtgaaactgtctatgcactacattctgctagctcctcttcaagtaaacgccaagtcacaa

SEQ ID NO: 116116 - DNA, 1883 bp, Homo sapiens
  Payload ID: 2648
  Gene Symbol: CDC14A
  Gene Name: cell division cycle 14A
  Uniprot ID: Q9UNH5
  ENST ID: ENST00000370124
  CDS Start-End: 454-1605
ccggagcagctgctgccagcccgcgggcactgaagtcctcccggctgccgctcgagtagccacgggcgcgatcgggaccagaagtctcctcctccatgatcactttggaagccgggggaagactttgccctgccctgagagctggtctgcgtttcccaggcgcggcggcggcggagcagcagctgcagcagccgagtccaaataggagcggccacagccaggggcgtgagcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacttcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggtaagttttccctaggagattctatcttcttaaaactgatgttctgcatttgtttctcagttggacctatataacatagcagtgtcttttctctggatgccacgagtaccaagtttttagaagtagagccatccgtctatatagcaagaagcagaggaaagaaaccaattgcccttaaaaaaaaaaaagctataatttaaggagtaaattataaaggaggctactctggtaaggggtaatatttatagaaaggaaacagaaaagcaaactttctatttgaaaattaaaataaa

SEQ ID NO: 116117 - DNA, 841 bp, Homo sapiens
  Payload ID: 2648
  Gene Symbol: CDC14A
  Gene Name: cell division cycle 14A
  ENST ID: ENST00000455467
  CDS Start-End: 24-841
gatgagagggcgtggagaaccagatgggaaactttttgtcccgtgagaacaaagtacaagttatatcagagtctgatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaagg

SEQ ID NO: 116118 - DNA, 2056 bp, Homo sapiens
  Payload ID: 2648
  Gene Symbol: CDC14A
  Gene Name: cell division cycle 14A
  ENST ID: ENST00000635056
  CDS Start-End: 285-1982
agcaggggaatttaggaatccattgaggatgcctgaatggggttgttggccctgatcacactctagagacaggcatatcatcacaggcaatcagaaatgaagaaggacattaacttgtaccctgtggaattgtcttcagttgataaaaaggacttctctatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatccctgtaagtgcgcagacaccacctcctggtcctcagaaccctgaatgcaacttctgtgccttgccttcccagccgaggctgccaccaaagaaatttaatagtgccaaggaagccttctgagcgatgccttccctctgtgctgtgaaactgtctatgcactacattctgctagctcctcttcaagtaaacgccaa

SEQ ID NO: 116119 - DNA, 2547 bp, Homo sapiens
  Payload ID: 2649
  Gene Symbol: CDC14B
  Gene Name: cell division cycle 14B
  Uniprot ID: O60729
  ENST ID: ENST00000375240
  CDS Start-End: 1-1380
atgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcactctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaaatggggcccg

SEQ ID NO: 116120 - DNA, 5589 bp, Homo sapiens
  Payload ID: 2649
  Gene Symbol: CDC14B
  Gene Name: cell division cycle 14B
  Uniprot ID: O60729
  ENST ID: ENST00000375241
  CDS Start-End: 453-1949
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 116121 - DNA, 2965 bp, Homo sapiens
  Payload ID: 2649
  Gene Symbol: CDC14B
  Gene Name: cell division cycle 14B
  Uniprot ID: O60729
  ENST ID: ENST00000375242
  CDS Start-End: 439-1824
ccttttgctcgaagtcctttaatcgctaaggagctttcccagactcttccctctgcaggcccgctggcctctgacgcatgtcccctctgcggagcgtttgggcactggaggagccctggttggcacaggccgccccgcgttcccagctggggaaggaaggcgggcggccaggcggggggaaagaaagcgggaggtggggcggggtgctgtccgtccccacggcctcgtcgcgcgcggggctttttccaggacttggggacttccggggttgcgctgtcgtgtcaggccgttgggccgccgaggggtgtcgctgcgcccgctgccccgcgcggccctttaaactttgttttttaaacttcgggggtgtggtcgcggcgcctcccctctcggcggctggcagtccttgcctctgccccgccttccagatgctttggagtcatgagccgggagggcgcgggggcagctttggtagccgaggtgatcaaagatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgct

SEQ ID NO: 116122 - DNA, 804 bp, Homo sapiens
  Payload ID: 2649
  Gene Symbol: CDC14B
  Gene Name: cell division cycle 14B
  ENST ID: ENST00000452280
  CDS Start-End: 1-804
gatgctttggagtcatgagccgggagggcgcgggggcagctttggtagccgaggtgatcaaaggaaggaacattgcaatttttccatttcagatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccc

SEQ ID NO: 116123 - DNA, 684 bp, Homo sapiens
  Payload ID: 2649
  Gene Symbol: CDC14B
  Gene Name: cell division cycle 14B
  ENST ID: ENST00000415608
  CDS Start-End: 1-684
gctccccgccggggcctcgagaaggaaggtgtcacgttggtggcattcgagccagccggcaagacgaatgtccgggttgtcacttttgagaaatcccagccagccagagcagatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattct

SEQ ID NO: 116124 - DNA, 5271 bp, Homo sapiens
  Payload ID: 2649
  Gene Symbol: CDC14B
  Gene Name: cell division cycle 14B
  ENST ID: ENST00000412285
  CDS Start-End: 1-1443
gagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaacagcc

SEQ ID NO: 116125 - DNA, 4960 bp, Homo sapiens
  Payload ID: 2649
  Gene Symbol: CDC14B
  Gene Name: cell division cycle 14B
  Uniprot ID: O60729
  ENST ID: ENST00000474602
  CDS Start-End: 453-1868
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcaccgatggttggctgtcccaggctgtcacctttctagaccggcttctgatctggctcgggatccacaaggactagacctgcggggaaggtctctcctggacacgcccgttgcccactgcaagttctctccaggtgcaattgaagcctctcagcagcggaggccgccatgtggagagagcaggcaggcccactgctgctgagaacagggcaggcacgggcagctcctgttctgcctttcccagcttcggagacgcaggctcagctgctccgaagcacctgccagcaccgcacagtacagtttcagaggacagcagtctccttcccgtgaagctcccatgtgctggaatggcatggacttgctgatcaacagaaggaaatggtctgaagtctgaccagcacaaggaaggaggctggctggctcagaggggcccaccttgcgtggaatgaaaacgccaaaggctcatgagcaacattaggctagaggggtcttgttcaaagcatccaactctgacttcggaggcattcccagccggcagcagtgtgtccagcctgcctcttcccaggctggtctgacatgcagcttaggctttcatcccaagttaggtactgacccctccctcttgggcagcacctccctttttaaaaaaatttttttttcttccaaagacagagtcttgctcttgttgtccaggctggagtgcagtggcgcgatctaggctcactgcaacctccttctcccaggttcaagcgactctcctgcctcagcctcctgagtagctgggattataggcgtctgccaccacgcccggctaatttctgtatttttagtagagacagggtttcaccatgttggccaggctggtctcgaactcctgacctcaagtgatctgcctgccttggcctcccaaagtgctgggattacaggtgtcagccaccgcacccagccaagcacccctatctctagaggatctggccccccagcccagttactgcagggcagctttccccacctggtgacaggctgtgcgcagcagccccaggacctcaccctgagctgagtcttcaggagccgccctggtggcacaactcagacacccctgaggcctagcagtcaactcctgattcagacatgatccagtccagcctgggcttggctataaccagctcaaacttgcttgacctccacttttcaggagacttggggacgacagccctcatcggcgtctttcatggggttaatctgcttgagtctaagtcgccagccagaaacgtggtgcccagggtgccctgcctcaggacatgtccacacccacgtcacaagcacctgaggagtccggccggggcactgtggtccaaaaggtcctgccgcctccgcatctgactgtcccaacggcatgctggtgacacccccctgcccttcgcttctgtcctccctggcttctctggggcacttggggctatgtacaacctggcacgatccagaaagggtgcaaacaaaatgcctacatccaggcacacgaccaagtcagcgagagctagccctggtaagcaaacatagcccattacaggttcagaacgtgcaccgggttccccaaaactgtcttcaaccacatgactcaacagctctatgggataggaactgtcagtgtttttgcaactgcaacattaaaccaagtgctgtgggcttttcaagtattattcacaacactaaaggaaagtttcttcaaagggctctctggctaatcttcaaagccgcagttaggcaaaatgacagtgtgacagcttcaaagccactgactcatgacacagccctgatgttgtaccggctaggttcagatttcagaaatcagggcacttgcatccattgccttttccaggaaagggaagaaaacactcagttgataaaccttagtactcagataataaataagagaccaaaagtaggctatcacccaaagcaaacatccttaactgaccctaacgtgtatggattcaactttgattattcaacaaaatcatgaccgactgctgtggcctggagtaaccaaaggactgttttctctacacaaagtcaggagcgaataccaacctttatttgcacttgggttccagttcaaagccaccttagacagtgtggcaaagtgggaaaaagcacagatcctgggaccaaggttcagattccatctcaagcgagcatatgaactgtgtgacaacaggcagacagtacctctgtgtctatgagaaagcggggagagcaacaccccagcttctagcagctctacagctgcctggacctgcaggccctcctaggcccacttcctccccagcacagtgtgtgttcccgggcgtgtgtggctctgggtccagctctgttcagggtgggactccaggtgaattactgaacctctgaggtgtacccccaaccccaaactttcaccaaaagcaataaagaggaactctagaactggagccaggactaagtgagaaaaactgcttataagtgcttaataaatactagttatttacaacttttgctcaagccgagggcagaggcctttgtacgcagctgccgaactctgactctagttctgcggaagaaaaggatgcggtatttgcttttgccatgatccctttccatttgattggcaggttaaataacatggtttttgaagtcacatacttaatattcttcctaaaaaccacccaaacactagatgtgtgtgtgcacacacacagaaaccacgaggtagtttaaatcaccattaaaaatcaacgctttctctgattctgtgtcacagagtggtggccagtggctacacaatagcgatttttaaatgattggttaagtgaaaaccagaactcaaaatattccaggagagaagataacatttacaagtaaacagtaagtgcaattgtattttaatttcttggtctccgaaaactcagctgtgactgctttccattaacagttccagctctatgtgtttcctctaacgctaaaggcacagcccccgggaatctactgcttcctaagagtctccatggagtctattttacaacctcctttccctccatgcttccgcggaggagtctatactatctctatatacacattttaaacattattcttcatttgaaattccttcaataaaaacacagtcaccatt

SEQ ID NO: 116126 - DNA, 1734 bp, Homo sapiens
  Payload ID: 2649
  Gene Symbol: CDC14B
  Gene Name: cell division cycle 14B
  Uniprot ID: O60729
  ENST ID: ENST00000463569
  CDS Start-End: 23-1480
ctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgcttctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatg

SEQ ID NO: 116127 - DNA, 2034 bp, Homo sapiens
  Payload ID: 2650
  Gene Symbol: CDC16
  Gene Name: cell division cycle 16
  Uniprot ID: Q13042
  ENST ID: ENST00000252457
  CDS Start-End: 25-1884
gcgtgaggccgggcccgcgccgccatgaacctagagcggctgcggaagcgcgtccggcagtacctcgaccagcaacagtatcaaagtgctctattttgggcagataaagtagcttcactctctcgtgaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatc

SEQ ID NO: 116128 - DNA, 1991 bp, Homo sapiens
  Payload ID: 2650
  Gene Symbol: CDC16
  Gene Name: cell division cycle 16
  ENST ID: ENST00000252458
  CDS Start-End: 284-1711
cgccatgaacctagagcggctgcggaagcgcgtccggcagtacctcgaccagcaacagtatcaaagtgctctattttgggcagataaagtagcttcactctctcgtgaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaaggatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaa

SEQ ID NO: 116129 - DNA, 2203 bp, Homo sapiens
  Payload ID: 2650
  Gene Symbol: CDC16
  Gene Name: cell division cycle 16
  Uniprot ID: Q13042
  ENST ID: ENST00000356221
  CDS Start-End: 109-1971
cggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatc

SEQ ID NO: 116130 - DNA, 2211 bp, Homo sapiens
  Payload ID: 2650
  Gene Symbol: CDC16
  Gene Name: cell division cycle 16
  Uniprot ID: Q13042
  ENST ID: ENST00000360383
  CDS Start-End: 199-2061
gagcctgggcagtgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatc

SEQ ID NO: 116131 - DNA, 2034 bp, Homo sapiens; identical to SEQ ID NO: 116127
  Payload ID: 2650
  Gene Symbol: CDC16
  Gene Name: cell division cycle 16
  Uniprot ID: Q13042
  ENST ID: ENST00000375308
  CDS Start-End: 304-1884

SEQ ID NO: 116132 - DNA, 2156 bp, Homo sapiens
  Payload ID: 2650
  Gene Symbol: CDC16
  Gene Name: cell division cycle 16
  Uniprot ID: Q13042
  ENST ID: ENST00000375310
  CDS Start-End: 426-2006
gcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaaccccaggacatctattggttggctcagtgtctttacctgacagcacaatatcacagagccgcccatgcacttcggtcacgaaaactggacaaattgtatgaagcatgtcgttaccttgcagctaggtgccataagtcgtgagtgatgagcggcacttctgttttccacgtagtatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatc

SEQ ID NO: 116133 - DNA, 2058 bp, Homo sapiens
  Payload ID: 2650
  Gene Symbol: CDC16
  Gene Name: cell division cycle 16
  ENST ID: ENST00000628084
  CDS Start-End: 481-1908
gagcctgggcagtgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaaggatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatc

SEQ ID NO: 116134 - DNA, 1675 bp, Homo sapiens
  Payload ID: 2651
  Gene Symbol: CDC20
  Gene Name: cell division cycle 20
  Uniprot ID: Q12834
  ENST ID: ENST00000310955
  CDS Start-End: 102-1601
gaggcgtaagccaggcgtgttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 116135 - DNA, 1777 bp, Homo sapiens
  Payload ID: 2651
  Gene Symbol: CDC20
  Gene Name: cell division cycle 20
  Uniprot ID: Q12834
  ENST ID: ENST00000372462
  CDS Start-End: 204-1703
ggtggtggggctgagccgaggtggggccgtggccagggggagggggtgctaggccggaaggggctgcagccgagggtggccctgattttgtggccggccaggagcgaaggggtccctttctgtcccctgagcaccgtcgcctcctttcctccagggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 116136 - DNA, 2946 bp, Homo sapiens
  Payload ID: 2652
  Gene Symbol: CDC20B
  Gene Name: cell division cycle 20B
  Uniprot ID: Q86Y33
  ENST ID: ENST00000296733
  CDS Start-End: 176-1723
agcggcggtgggaggagtgggggacctggagggaggtggtgaaatagaatggtcctgggggacgggactccaggggtttgacgattaggcgtcaagactgacttagacctgggaagaaaaccagaggcagtcgagcagagaggccaaacgccaggcagggcgaagtcagccggagatggagtggaaactggagcgcaccgcgcctcggagggtccgcacggaagaggagatgctgtgggaaagtatcatgcgtgtgctctccaaagacttgaagcagaagagaagtcaagattccgccaacgtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcccgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaaggctgcaaagatggagtcagagatgaatccttccatcttaaaagttctggtgatataaacgattccatactccaaccagaggtgaagattcatattactggtcttcgaaatgactactatctgaatatcctagattggagttttcagaatcttgttgccatagccctgggctctgctgtatacatctggaatggggagaaccacaatgggattgaaaacatagacttaagtctcacttgtaactatatctcttctgtgtcctggataaaagagggaacttgcctggcagttggcaccagcgagggagaagtgcaattatgggatgtggtaactaaaaagcggctgagaaatatgcttggtcatttgtcagtagttggggctctgagctggaatcactttatcctcagcagtgggtcaagactggggcgtgtttatcatcacgatgttcgggtagcccagcatcatgttggaacacttcgccacaagcaagctgtgtgtgctctgaagtggtcaccggatggcaggctgctttccagcggctgcagtgatggactgctgacaatatggccccacgatccaggtgccagtgcacagggccaaccgctgaaagtcataacccagtctacggcagtcaaggccatggattggtgtccctggcagtctggggtccttgccattggaggaggaatgaaggatggacgcttacacatcttggatataaatgctgggaagagcatccagaccccaagcacaaactcacagatttgttccttaatctggctacctaagacaaaggagattgcaactggtcaaggtactcccaagaatgatgtgactgtgtggacctgtcccactgtgtccaggtcaggccacaggggcagagtgctgcacctgtctttgagtccagaccagacccgggtgttttctgctgcagctgatgggacggcctctgtatggaattgctactagcacccagcccctctaggtttcagtttccttatttctgagtgaagatgatgatgttggctatgtcttctccatggggtttttatgagtatcaaacaagttgaaatactcttcttgatgtgaatgcctgttctcctgttcttcttttgcagattgctttacttgctctgcttcccagagatccgcttcttttcttctctgctttcttctttctgcccctcttcctccccctcctcttcttcctcccattcttacccctttctagagattcattttcactactttattcagaataacatctatagcaaagatttctacttctttcccgtatgacttttctccccagctccaaacctcatatttctgattgcctcaggatagttcccttttgagatactttcctgtctttagctcaatctcaacacattgaaaacacaactcattcacttgaaaaacacttactaaaatctcactatatgctaggcagtatgttaagcatgcatattgctctctctaaaaatcagttctgtaggaatccctttcccctcctgatggtctcatccttatcctggtctcccactcagggaacctcctgattattctgctctgtgcttcctcagttcaccctttgctctcttttcttttgcttcacctagtcacatcctgtgtgcctgacagccagtctgctgtaattgtcttagaactgatcctcttgactccacaccactgctaggttgaacatctaaaagtcctgtgctgatcctctcagtcccctgctcatcaactctcaaggacaacctattaccaaacacctttgacctcaacctctggagtcctcagcccaggacttgaagttaggagatctttttttgccttggctctgccataaatacaccctgtaaccttggatgtgttgcaacatctgcaaggataggaatttgatcactgctaaggttccttcaaacttgatcagttcgctgttctgtcttttgaatgttaattcacattcatctcctatattaagactttggctaagtcttgtgatttcttgccttattggagcttttcttctaatctgaattcttgcttctctctccttttcctttacacacccacacaagtcctaacctctccaggaagtgttttgaaatgatgttacctgggtttgagttcttggcattagcctgtatcatctatttggtattattatactattatagctgttt

SEQ ID NO: 116137 - DNA, 1679 bp, Homo sapiens
  Payload ID: 2652
  Gene Symbol: CDC20B
  Gene Name: cell division cycle 20B
  Uniprot ID: Q86Y33
  ENST ID: ENST00000322374
  CDS Start-End: 176-1609
agcggcggtgggaggagtgggggacctggagggaggtggtgaaatagaatggtcctgggggacgggactccaggggtttgacgattaggcgtcaagactgacttagacctgggaagaaaaccagaggcagtcgagcagagaggccaaacgccaggcagggcgaagtcagccggagatggagtggaaactggagcgcaccgcgcctcggagggtccgcacggaagaggagatgctgtgggaaagtatcatgcgtgtgctctccaaagacttgaagcagaagagaagtcaagattccgccaacgtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcccgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaaggctgcaaagatggagtcagagatgaatccttccatcttaaaagttctggtgatataaacgattccatactccaaccagaggtgaagattcatattactggtcttcgaaatgactactatctgaatatcctagattggagttttcagaatcttgttgccatagccctgggctctgctgtatacatctggaatggggagaaccacaatgggattgaaaacatagacttaagtctcacttgtaactatatctcttctgtgtcctggataaaagagggaacttgcctggcagttggcaccagcgagggagaagtgcaattatgggatgtggtaactaaaaagcggctgagaaatatgcttggtcatttgtcagtagttggggctctgagctggaatcactttatcctcagcagtgggtcaagactggggcgtgtttatcatcacgatgttcgggtagcccagcatcatgttggaacacttcgccacaagcaagctgtgtgtgctctgaagtggtcaccggatggcaggctgctttccagcggctgcagtgatggactgctgacaatatggccccacgatccaggtgccagtgcacagggccaaccgctgaaagtcataacccagtctacggcagtcaagatttgttccttaatctggctacctaagacaaaggagattgcaactggtcaaggtactcccaagaatgatgtgactgtgtggacctgtcccactgtgtccaggtcaggtgggttttttggccacaggggcagagtgctgcacctgtctttgagtccagaccagacccgggtgttttctgctgcagctgatgggacggcctctgtatggaattgctactagcacccagcccctctaggtttcagtttccttatttctgagtgaagatgatgatgttggctatgtcttctcc

SEQ ID NO: 116138 - DNA, 2591 bp, Homo sapiens
  Payload ID: 2652
  Gene Symbol: CDC20B
  Gene Name: cell division cycle 20B
  Uniprot ID: Q86Y33
  ENST ID: ENST00000381375
  CDS Start-End: 147-1706
agggaggtggtgaaatagaatggtcctgggggacgggactccaggggtttgacgattaggcgtcaagactgacttagacctgggaagaaaaccagaggcagtcgagcagagaggccaaacgccaggcagggcgaagtcagccggagatggagtggaaactggagcgcaccgcgcctcggagggtccgcacggaagaggagatgctgtgggaaagtatcatgcgtgtgctctccaaagacttgaagcagaagagaagtcaagattccgccaacgtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcccgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaaggctgcaaagatggagtcagagatgaatccttccatcttaaaagttctggtgatataaacgattccatactccaaccagaggtgaagattcatattactggtcttcgaaatgactactatctgaatatcctagattggagttttcagaatcttgttgccatagccctgggctctgctgtatacatctggaatggggagaaccacaatgggattgaaaacatagacttaagtctcacttgtaactatatctcttctgtgtcctggataaaagagggaacttgcctggcagttggcaccagcgagggagaagtgcaattatgggatgtggtaactaaaaagcggctgagaaatatgcttggtcatttgtcagtagttggggctctgagctggaatcactttatcctcagcagtgggtcaagactggggcgtgtttatcatcacgatgttcgggtagcccagcatcatgttggaacacttcgccacaagcaagctgtgtgtgctctgaagtggtcaccggatggcaggctgctttccagcggctgcagtgatggactgctgacaatatggccccacgatccaggtgccagtgcacagggccaaccgctgaaagtcataacccagtctacggcagtcaaggccatggattggtgtccctggcagtctggggtccttgccattggaggaggaatgaaggatggacgcttacacatcttggatataaatgctgggaagagcatccagaccccaagcacaaactcacagatttgttccttaatctggctacctaagacaaaggagattgcaactggtcaaggtactcccaagaatgatgtgactgtgtggacctgtcccactgtgtccaggtcaggtgggttttttggccacaggggcagagtgctgcacctgtctttgagtccagaccagacccgggtgttttctgctgcagctgatgggacggcctctgtatggaattgctactagcacccagcccctctaggtttcagtttccttatttctgagtgaagatgatgatgttggctatgtcttctccatggggtttttatgagtatcaaacaagttgaaatactcttcttgatgtgaatgcctgttctcctgttcttcttttgcagattgctttacttgctctgcttcccagagatccgcttcttttcttctctgctttcttctttctgcccctcttcctccccctcctcttcttcctcccattcttacccctttctagagattcattttcactactttattcagaataacatctatagcaaagatttctacttctttcccgtatgacttttctccccagctccaaacctcatatttctgattgcctcaggatagttcccttttgagatactttcctgtctttagctcaatctcaacacattgaaaacacaactcattcacttgaaaaacacttactaaaatctcactatatgctaggcagtatgttaagcatgcatattgctctctctaaaaatcagttctgtaggaatccctttcccctcctgatggtctcatccttatcctggtctcccactcagggaacctcctgattattctgctctgtgcttcctcagttcaccctttgctctcttttcttttgcttcacctagtcacatcctgtgtgcctgacagccagtctgctgtaattgtcttagaactgatcctcttgactccacaccactgctaggttgaacatctaaaagtcctgtgctgatcctctcagtcccctgctcatcaactctcaaggacaacctattaccaaacacctttgacctcaacctctggagtcctcagcccaggacttgaagttaggagatctttttttgccttggctctgccata

SEQ ID NO: 116139 - DNA, 2130 bp, Homo sapiens
  Payload ID: 2652
  Gene Symbol: CDC20B
  Gene Name: cell division cycle 20B
  Uniprot ID: Q86Y33
  ENST ID: ENST00000507931
  CDS Start-End: 162-740
gagtgggggacctggagggaggtggtgaaatagaatggtcctgggggacgggactccaggggtttgacgattaggcgtcaagactgacttagacctgggaagaaaaccagaggcagtcgagcagagaggccaaacgccaggcagggcgaagtcagccggagatggagtggaaactggagcgcaccgcgcctcggagggtccgcacggaagaggagatgctgtgggtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcccgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaagatcactttagtggcagcatgaagaaacgatttgaacaggaggatgttggtggcaaagactaattgagaggccctctgaatactctatgcaaggctctgttgttgattcttttaagggaacttaaactatgaaacagatcccacataagccaagtaattgctcatcagtggatcacggggacaaatgttatccaaatgctgtgtatataaagcaattctttatgccttgtccatatctaatgactctgaaaccttacagcaggcagcccctgtaaactttcaggtgtacctctttgccgaaagctggtaggaaactttggatggtggtgttgtgagcgttatcagggaagctctgtagccatgcagtggggagataattgcctgtggcaatttctagaaggtcctgttccatgctacatttggagctctcagtgctttctttcttttttttttttttttttgagacagagtctcgctctgttgcccaagctggagtgcagtggcgcgatctcagttcactgcaacctctgtctcccgggttcaagcgattctcctgtctcagcttgggattacaggcacacaccaccatgcccagctaatttttgtatttttagtagagaaggggtttcaccatgttggccagactggtctccaactcctgacctcagatgctccacccgcctcagccttccaaaatactgagattataggcatgagccactgtgcttggcctcccaaagtcttttgaccctgagccccatgtgttttcattcctactttctgttgccatcatggacgtttttgtgttattcatgagattattgtcatggctggaaaataattgtttgggagccagaattctgtgtgagaatcctcttgagagaactagcgtggttcatttcataaatgccaaggaaacttgcctgctacatttcccctctggaataagttctggtaagcatatccatggggtgctttggcaaggtctcaaaaataaatgtgaacaaggagacagaaatcctcaatgctaaagtagacttctatttttatggcttgtcctattttttttttttttttttgagatgaagtcttgctctatcgtccaggctggagtgcagtagtgtgatcttggctcatggcaacctccacctcccgggagaattgcttgaaccagggaggcggaagttgcagtgagctgagaccgtgccactgctctctagcttggctgacagagtgagactctgtctcaaaaaaaaaaatattttttttggaaattttcttttaaaaattatgtagataacacatagatacacacttttaacttctaaatacagaggtgtccaatcttttggcttccctgggccacattggaagaaggattgttttgggccacatatagaatacactaatactaaagatagctgatgagctaaaaaaaaaaaaaaaaaaaaaa

SEQ ID NO: 116140 - DNA, 1548 bp, Homo sapiens
  Payload ID: 2652
  Gene Symbol: CDC20B
  Gene Name: cell division cycle 20B
  Uniprot ID: Q86Y33
  ENST ID: ENST00000513180
  CDS Start-End: 16-1134
cgaagtcagccggagatggagtggaaactggagcgcaccgcgcctcggagggtccgcacggaagaggagatgctgtgggaaagtatcatgcgtgtgctctccaaagacttgaagcagaagagaagtcaagattccgccaacgtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcccgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaaggctgcaaagatggagtcagagatgaatccttccatcttaaaagttctggtgatataaacgattccatactccaaccagaggtgaagattcatattactggtcttcgaaatgactactatctgaatatcctagattggagttttcagaatcttgttgccatagccctgggctctgctgtatacatctggaatggggagaaccacaatgggattgaaaacatagacttaagtctcacttgtaactatatctcttctgtgtcctggataaaagagggaacttgcctggcagttggcaccagcgagggagaagtgcaattatgggatgtggtaactaaaaagcggctgagaaatatgcttggtcatttgtcagtagttggggctctgagctggaatcactttatcctcagcaggctggagttcagtggcgtgatctcagctcactgcaacctccacctcccgagtagctgggactacaggcgcccaccaccatgcctggtgggtcaagactggggcgtgtttatcatcacgatgttcgggtagcccagcatcatgttggaacacttcgccacaagcaagctgtgtgtgctctgaagtggtcaccggatggcaggctgctttccagcggctgcagtgatggactgctgacaatatggccccacgatccaggtgccagtgcacagggccaaccgctgaaagtcataacccagtctacggcagtcaaggccatggattggtgtccctggcagtctggggtccttgccattggaggaggaatgaaggatggacgcttacacatcttggatataaatgctgggaagagcatccagaccccaagcacaaactcacagatttgttccttaatctggctacctaagacaaaggagattgcaactggtcaaggtactcccaagaatgatgtgactgtgtggacctgtcccactgtgtccaggtcag

SEQ ID NO: 116141 - DNA, 1079 bp, Homo sapiens
  Payload ID: 2653
  Gene Symbol: CDC23
  Gene Name: cell division cycle 23
  Uniprot ID: Q9UJX2
  ENST ID: ENST00000394884
  CDS Start-End: 32-487
atgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctggtgagggccattttaaaatgtcattctgcctttagtgaaacatccatatttagaaccaatggaaaagttaaatcttttaaatagcttagcagtgggccactgaatgaatgtactttatacatagcaataataaaaaaaagatatcataaataaagttaaaaaggatggtagagaagaaaatattcttaggaatgactaacaggataagtaacaacctgattatttatttactttaggttatataaggttcttcatgcctgtgaattaatattattgtgtaagaattaagttaaaaagcctgggctgacttttaaatttataaattcatttatcatgtttatagtatatttattgtttttctttcatggctattaaaaagtatgactgtaaaggacaatgcaagtaaaccaacttaatactgtattgaataataagtacaatttattattttactttgaaacattatgaatttactttcctactttttcttagttgttatctatataaattgattaaaaaaacattttatgtacttctcatttcctagtacaggttgagtatcccttatttgaagtgcttgggaccaaaagtgtttcagatttcagatttttttcagattttggtatatttgcattatacttactggttgaaataaaaaatgctgcagtgagtgtca

SEQ ID NO: 116142 - DNA, 3155 bp, Homo sapiens
  Payload ID: 2653
  Gene Symbol: CDC23
  Gene Name: cell division cycle 23
  Uniprot ID: Q9UJX2
  ENST ID: ENST00000394886
  CDS Start-End: 32-1825
atgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctgtctggagaaaaaaagaaggacgatgaaacagttgatagcttaggccccctggaaaaaggacaagtgaaaaatgaggcgcttagagaattgagagtggagctcagcaaaaaacaccaagctcgagaacttgatggatttggactttatctgtatggtgtggtgcttcgaaaactggacttggttaaagaggccattgatgtgtttgtggaagctactcatgttttgcccttgcattggggagcctggttagaactctgtaacctgatcacagacaaagagatgctgaagttcctgtctttgccagacacctggatgaaagagttttttctggctcatatatacacagagttgcagttgatagaggaggccctgcaaaagtatcagaatctcattgatgtgggcttctctaagagctcgtatattgtttcccaaattgcagttgcctatcacaatatcagagatattgacaaagccctctccatttttaatgagctaaggaaacaagacccttacaggattgaaaatatggacacattctccaaccttctttatgtcaggagcatgaaatcggagttgagttatctggctcataacctctgtgagattgataaatatcgtgtagaaacgtgctgtgtaattggcaattattacagtttacgttctcagcatgagaaagcagccttatatttccagagagccctgaaattaaatcctcggtatcttggtgcctggacactaatgggacatgagtacatggagatgaagaacacgtctgctgctatccaggcttatagacatgccattgaggtcaacaaacgggactacagagcttggtatggcctcgggcagacctatgaaatccttaagatgccattttactgcctttattattatagacgggcccaccagcttcgacccaatgattctcgcatgctggttgctttaggagaatgttacgagaaactcaatcaactagtggaagccaaaaagtgttattggagagcttacgccgtgggagatgtggagaaaatggctctggtgaaactggcaaagcttcatgaacagttgactgagtcagaacaggctgcccagtgttacatcaaatatatccaagatatctattcctgtggggaaatagtagaacacttggaggaaagcactgcctttcgctatctggcccagtactattttaagtgcaaactgtgggatgaagcttcaacttgtgcacaaaagtgttgtgcatttaatgatacccgggaagaaggtaaggccttactccggcaaatcctacagcttcggaaccaaggcgagactcctaccaccgaggtgcctgctccctttttcctacctgcttcactctctgctaacaatacccccacacgcagagtttctccactcaacttgtcttctgtcacgccatagttggctactctcaagccagcacattgttagacccatcttaattaagccttacctccatgtaaagaacagcacgtctgttccaaggacctcagctcttcttgtttctacagatggcaacagctccatagggacagcttgtataattaccttcagaggccaactgacagaatcctggcaggaacagacattatcttgccagttagaagtacttctgtctcacttatgtccaaagagtggctatagatcttggccttcttccctgaatgctttttttttttggcccccaagaaagtcccttttatagcactttagcacaggcaatgctacaggaacaaagtttcaatgctgctgagagtgaaagaaaggaggaaagtctgccactctaccctgagctggcagtagggcactgagtaccctaggaagaagtcagagcaatggatacaaatgaccttgctcttggatttgctgagcatgatccctattctgatgtcagagattaggtttaaatggaatagagctatccatttgttcttactctctagggagacaatcttccaaaacagttttgggggggtcttctaaagctttcaaattggaagtaactttattcaactagagttgaataaaagaagggcaaaaataatctcacagagcttggaactgctgatagcccttactgagggcaaaagatggctatattgttagctatactcctaccaaagcaagcaaggagataggattatagataatttcacggacatttggaaataacattggtgattatacagacaagaataaactcacttcaagctggtctgttttaataaattttcaacgtaattgtctatttttttccctcccatctgcaacagaatacatttttttcagcctttatctagatgaggtaaagggaatcattcttatggtgctcttggagagtttcaggcctgtgcatgtgtgtacagcaggaggtaatatgctataatgtctgctgtaatatatttgcacagtagatgctatggatcattctgagctcagggtccagactttattcttattcccagaattttgtgttacgtttttacctcctaacatatgacacttcatcttatattaaggaaggtttagaatatctaatacgacttgaattcatttgttactaagccttctcaggcaagctgtatactagttactggtctccactgccatgccttttcaaggttcccatggtccagaatgatgtttgattcttaatttttctgtcccttttataatttgttttaatgattttgctacatttggaattcaataaaaaatgtgaacaataata

SEQ ID NO: 116143 - DNA, 549 bp, Homo sapiens
  Payload ID: 2653
  Gene Symbol: CDC23
  Gene Name: cell division cycle 23
  ENST ID: ENST00000483961
  CDS Start-End: 12-341
gagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggaagatgcccaggatatggatgcctataccctggccaaggcctactttgacgttaaagagtatgatcgggcagcacatttcctgcatggctgcaatagcaagaaagcctattttctgtatatgtattccagatatctggccccctggaaaaaggacaagtgaaaaatgaggcgcttagagaattgagagtggagctcagcaaaaaacaccaagctcgagaacttgatggatttggactttatctgtatggtgtggtgcttcgaaaactggacttggttaaagaggccattgatgtgtttgtggaagctactcatgttttgcccttgcattggggagcctggttagaactctgtaacctgatcacagacaaagagatg

SEQ ID NO: 116144 - DNA, 584 bp, Homo sapiens
  Payload ID: 2653
  Gene Symbol: CDC23
  Gene Name: cell division cycle 23
  ENST ID: ENST00000511383
  CDS Start-End: 1-403
gagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagagatgcccaggatatggatgcctataccctggccaaggcctactttgacgttaaagagtatgatcgggcagcacatttcctgcatggctgcaatagcaagaaagcctattttctgtatatgtattccagatatctgtctggagaaaaaaagaaggacgatgaaacagttgatagcttaggccccctggaaaaaggacaagtgaaaaatgaggcgcttagagaattgagagtggagctcagcaaaaaacaccaagctcgagaacttgatggatttggactttatctgtatggtgtggtgcttcgaaaactggacttggttaaagaggccattgatgtgtttgtggaagctactcatgtttt

SEQ ID NO: 116145 - DNA, 455 bp, Homo sapiens
  Payload ID: 2653
  Gene Symbol: CDC23
  Gene Name: cell division cycle 23
  ENST ID: ENST00000505120
  CDS Start-End: 12-383
gagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagagatgcccaggatatggatgcctataccctggccaaggcctactttgacgttaaagagtatgatcgggcagcacatttcctgcatggctgcaatagcaagaaagcctattttctgtatatgtattccagatatctggtgagggccattttaaaatgtcattctgcctttagtgaaacatccatatttagaaccaatggaaaagttaaatctt

SEQ ID NO: 116146 - DNA, 3783 bp, Homo sapiens
  Payload ID: 2654
  Gene Symbol: CDC25A
  Gene Name: cell division cycle 25A
  Uniprot ID: P30304
  ENST ID: ENST00000302506
  CDS Start-End: 410-1984
gtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatgaagcctttgagtttaagaagccagtaagacctgtatctcgtggctgcctgcactctcatggactccaggagggtaaagatctcttcacacagaggcagaactctgccccagctcggatgctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccatgctctctgcctagttcttgatggatttaagga

SEQ ID NO: 116147 - DNA, 3663 bp, Homo sapiens
  Payload ID: 2654
  Gene Symbol: CDC25A
  Gene Name: cell division cycle 25A
  Uniprot ID: P30304
  ENST ID: ENST00000351231
  CDS Start-End: 410-1864
gtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccatgctctctgcctagttcttgatggatttaagga

SEQ ID NO: 116148 - DNA, 730 bp, Homo sapiens
  Payload ID: 2654
  Gene Symbol: CDC25A
  Gene Name: cell division cycle 25A
  ENST ID: ENST00000437972
  CDS Start-End: 302-730
ccgcgaaaggccggcctggctgcgacagcctgggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaat

SEQ ID NO: 116149 - DNA, 777 bp, Homo sapiens
  Payload ID: 2654
  Gene Symbol: CDC25A
  Gene Name: cell division cycle 25A
  ENST ID: ENST00000443342
  CDS Start-End: 20-777
tgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctaagctgttgggatgtagtccagctctgaagaggagccattctgattctcttgaccatgacatctttcagctcatcgacccagatgagaacaaggaaaatgaagcctttgagtttaagaagccagtaagacctgtatctcgtggctgcctgcactctcatggactccaggagggtaaagatctcttcacacagaggcagaactctgccccagctcggatgctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgtgag

SEQ ID NO: 116150 - DNA, 3597 bp, Homo sapiens
  Payload ID: 2655
  Gene Symbol: CDC25B
  Gene Name: cell division cycle 25B
  Uniprot ID: P30305
  ENST ID: ENST00000245960
  CDS Start-End: 698-2440
gcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaacca

SEQ ID NO: 116151 - DNA, 3071 bp, Homo sapiens
  Payload ID: 2655
  Gene Symbol: CDC25B
  Gene Name: cell division cycle 25B
  ENST ID: ENST00000344256
  CDS Start-End: 361-1911
ggcgagcggggcggagcgggcggagcgggatctcgcgggaagcgcggggacgcccggcgcctcctccccgccctccgcgcccacccccttcccgccgccgggacataccgcgggggggcgctgcggcctgctggacctgcccgtgctgcggcctccggcgacccggcagcgacgcgggcggggacgcggtgcatcgctactgcgcccggcggacagcgacttgctgctcaaaaagaataagaaccagggtttttgtttgttttttttttttttaattaaggtaaaaataacgcacttttttttttgcggaacctgaaaaattcaagaagttgaaaaacgcttttcacgtcacctggagagatgcacagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaaccagca

SEQ ID NO: 116152 - DNA, 1978 bp, Homo sapiens
  Payload ID: 2655
  Gene Symbol: CDC25B
  Gene Name: cell division cycle 25B
  Uniprot ID: P30305
  ENST ID: ENST00000340833
  CDS Start-End: 102-1721
acccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggca

SEQ ID NO: 116153 - DNA, 2990 bp, Homo sapiens
  Payload ID: 2655
  Gene Symbol: CDC25B
  Gene Name: cell division cycle 25B
  ENST ID: ENST00000379598
  CDS Start-End: 361-1830
ggcgagcggggcggagcgggcggagcgggatctcgcgggaagcgcggggacgcccggcgcctcctccccgccctccgcgcccacccccttcccgccgccgggacataccgcgggggggcgctgcggcctgctggacctgcccgtgctgcggcctccggcgacccggcagcgacgcgggcggggacgcggtgcatcgctactgcgcccggcggacagcgacttgctgctcaaaaagaataagaaccagggtttttgtttgttttttttttttttaattaaggtaaaaataacgcacttttttttttgcggaacctgaaaaattcaagaagttgaaaaacgcttttcacgtcacctggagagatgcacagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaaccagca

SEQ ID NO: 116154 - DNA, 3096 bp, Homo sapiens
  Payload ID: 2655
  Gene Symbol: CDC25B
  Gene Name: cell division cycle 25B
  Uniprot ID: P30305
  ENST ID: ENST00000439880
  CDS Start-End: 242-1942
ggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 116155 - DNA, 2128 bp, Homo sapiens
  Payload ID: 2656
  Gene Symbol: CDC25C
  Gene Name: cell division cycle 25C
  Uniprot ID: P30307
  ENST ID: ENST00000323760
  CDS Start-End: 280-1701
gtttgaatggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgagaggtg

SEQ ID NO: 116156 - DNA, 1951 bp, Homo sapiens
  Payload ID: 2656
  Gene Symbol: CDC25C
  Gene Name: cell division cycle 25C
  Uniprot ID: P30307
  ENST ID: ENST00000348983
  CDS Start-End: 322-1524
agcttagaggcgagcggggataggttactgggctggcggaaggtttgaatggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtcacctggattcttcaggacttcaggaagtgcatttagctgggatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgagaggtg

SEQ ID NO: 116157 - DNA, 1556 bp, Homo sapiens
  Payload ID: 2656
  Gene Symbol: CDC25C
  Gene Name: cell division cycle 25C
  Uniprot ID: P30307
  ENST ID: ENST00000415130
  CDS Start-End: 235-1437
agaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtcacctggattcttcaggacttcaggaagtgcatttagctgggatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaa

SEQ ID NO: 116158 - DNA, 774 bp, Homo sapiens
  Payload ID: 2656
  Gene Symbol: CDC25C
  Gene Name: cell division cycle 25C
  ENST ID: ENST00000514017
  CDS Start-End: 1-774
gagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtaagcagatttctggagatggtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaagggga

SEQ ID NO: 116159 - DNA, 1968 bp, Homo sapiens
  Payload ID: 2656
  Gene Symbol: CDC25C
  Gene Name: cell division cycle 25C
  Uniprot ID: P30307
  ENST ID: ENST00000513970
  CDS Start-End: 435-1856
gaggtgcccgccccgaggccccagcgccacctgccctccaccacctaccgcggttcctccagctcccagggccgcggccggagcagctctgagcgctcggttcgccccacggtgcccttaaaaggcgctggcgcgaaccaacgagtccctgaggagagtagggggacagctccggctcgcagaatccccccaagccacccatggagggcgcagctccgtgtcgtgtctctctcaaagtgtctctcggacagcgctgttgggaacgagcctggcgctttgatttagggatgggggtggtttcctcactaacgagtcaccccctccaaaatatcgcagaaagtggacggccccagttggaggcacatcttgaaacccgcgggggaggccatgtcggaagaaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgc

SEQ ID NO: 116160 - DNA, 1332 bp, Homo sapiens
  Payload ID: 2656
  Gene Symbol: CDC25C
  Gene Name: cell division cycle 25C
  Uniprot ID: P30307
  ENST ID: ENST00000514555
  CDS Start-End: 1-1332
atgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatga

SEQ ID NO: 116161 - DNA, 867 bp, Homo sapiens
  Payload ID: 2656
  Gene Symbol: CDC25C
  Gene Name: cell division cycle 25C
  ENST ID: ENST00000510119
  CDS Start-End: 358-867
ctgccctccaccacctaccgcggttcctccagctcccagggccgcggccggagcagctctgagcgctcggttcgccccacggtgcccttaaaaggcgctggcgcgaaccaacgagtccctgaggagagtagggggacagctccggctcgcagaatccccccaagccacccatggagggcgcagctccgtgtcgtgtctctctcaaagtgtctctcggacagcgctgttgggaacgagcctggcgctttgatttagggatgggggtggtttcctcactaacgagtcaccccctccaaaatatcgcagaaagtggacggccccagttggaggcacatcttgaaacccgcgggggaggccatgtcggaagaagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaat

SEQ ID NO: 116162 - DNA, 1059 bp, Homo sapiens
  Payload ID: 2656
  Gene Symbol: CDC25C
  Gene Name: cell division cycle 25C
  ENST ID: ENST00000503022
  CDS Start-End: 313-1059
agaggcgagcggggataggttactgggctggcggaaggtttgaatggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaa

SEQ ID NO: 116163 - DNA, 872 bp, Homo sapiens
  Payload ID: 2657
  Gene Symbol: CDC26
  Gene Name: cell division cycle 26
  Uniprot ID: Q8NHZ8
  ENST ID: ENST00000374206
  CDS Start-End: 360-617
ggagcatgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaatatatttttggaaaaa

SEQ ID NO: 116164 - DNA, 5801 bp, Homo sapiens
  Payload ID: 2658
  Gene Symbol: CDC27
  Gene Name: cell division cycle 27
  Uniprot ID: P30260
  ENST ID: ENST00000066544
  CDS Start-End: 95-2569
tcgctggtgagtttaaatgagcaggggctggccgggccggagccgctacagggggggcctgaggcactgcagaaagtgggcctgagcctcgaggatgacggtgctgcaggaacccgtccaggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagtgacagctccacaaccaaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcagaaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagctgaaagaatattctcagaggttagaaggattgagaattatagagttgaaggcatggagatctactctacaacactttggcatcttcaaaaagatgttgctctttcagttctgtcaaaagacttaacagacatggataaaaattcgccagaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtgtttgcaagtgccagatggaacaataaaagacgttgcctataacagtgacttgattgccaaggaatgtaaattaccttaaacttgcagtatctcccataaacaaatgtaatgggcatattgggactcgtatgtaggaatcaaatatccctccatacagtgtactcttattcttggcaagaatgctttaatgtctaaccaagaattttaatttattcatcttgcttcaaagtgttgatcattgttgtcttggtattgcaaactttaaaattgtttcttaccatattgcctcttctctttgagctctgtgggatcacctttaacattcagagatgatagagtggttccccactgagaagccaaaacaaggcccttaataaccccttaagttcaccatatgaatcagaaggagaacactaaagtggagagacttttaagagatcatgatagtgaaagccttaatataatcagaattgtaccataaccttgaatctatatttgttcaaaacatccctttgacttttctaagtgtttgcttaagcagagtgtaagaatgtgtggttacctttggttgagatcctttccattctttttgactctctgcttcagattttttcagtagtgtgagtcaccaaaacatttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagtcttaaattgtttatctcctttactgtaatgtattgaaatttttagagaaattttagttgttaacattttattaagtgccagtgtcagaatataacaaattatagtttcttatgaatgacaggcctacagttattattctggattatttgatggaggacaaacttacctgtatttgttagtcaagctgtgaaaataaggtggattacaaaagatgtgaaaaaaattttagtctgtagactcagtaattttctataatttactgttaatctcatttgaacatggattaggtacaatttataaattaattcaagtcagggtctttaggtatcaggtgccagagagatatttaacagatttccctacctaaatttatgtatatgtactgtctaaaacaatacttttttaaaaaaaaggaacagttgggagaaaataaatataatgaaaaattcccagaggctagcacttggattctaacacgtatgctattgtattatccattagttctgtaatatttaattttagattcttttatttttttaattggcaaagcacaaggtgctgtataacagtgtcatttagagttttatagaaagcttcaacctgagttctgcgttataaagcctggagaaagctaagcttagaacataacttgctgaagtataattatctttttgtagcaggaatttatgtgccagaggtgagagtctttctggtactgattttttgagaccaaggataaaaggatcgttttgtaagacatgccatggcaatggctggttgggggacagtttccgcccaagcttggcctattttatttttcctcatacctactttcaaagtcatttaggtatttgaagccttatttcccacgtagtaacactttctggcttttgcagtttctttttttgtttggttttgttttttgcatggaatggggatcaaacaacccgaagaagaacacattttgatcaagcaaaatgtttgcttcaaatttcagaagtttattttacagaaattaaattaagtagtttgacatccttttctctgtttcacacatatattaggttggtgcataagtaattgtggtttttgccatgacttttatggcaaaacctgcaattacttttgcaccaacttaatacatctatatacatatatatatacgcgcacacacttgttcagaagttatgttgtggccttggatttgtttttccccttggaaatggttcttaactctgggattttagaaggttagaatattttttcaagagaacagtggtactcaaaagaatgaaaggtggtccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaaagtttggaagtctctgattagccagagtatagtatgagtcttcactgagaaatatggtgacccattttctttgtgaaaacctgggaaaatgcaagtgtgggtatgaagtgtgtgttctgtttgcattgaaacaatgtaattttgtgtcttctttttgctttaactgacttatttcagaaattgtacagtgttgagggggaaagtcttttctgttaatatatttgcaattcattaaaggatatggaaaatccaaataagttacttttgaaagcaatttataatcaagttgttaaagctatatgaaagctgtgccatctgtattttaataagaaggcacagaaaaacagagatacagttttatgtttcacaaaaaactagagcaatgtttatctaattttttaaaacttacactcttaatatatttatatttttaaacggtcatactcttttttagtattatttggaatatcaaaataaatactatgacaaaaacaa

SEQ ID NO: 116165 - DNA, 1420 bp, Homo sapiens
  Payload ID: 2658
  Gene Symbol: CDC27
  Gene Name: cell division cycle 27
  ENST ID: ENST00000526866
  CDS Start-End: 93-1124
gctggtgagtttaaatgagcaggggctggccgggccggagccgctacagggggggcctgaggcactgcagaaagtgggcctgagcctcgaggatgacggtgctgcaggaacccgtccaggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaaggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctctt

SEQ ID NO: 116166 - DNA, 2570 bp, Homo sapiens
  Payload ID: 2658
  Gene Symbol: CDC27
  Gene Name: cell division cycle 27
  ENST ID: ENST00000533415
  CDS Start-End: 80-364
aatgagcaggggctggccgggccggagccgctacagggggggcctgaggcactgcagaaagtgggcctgagcctcgaggatgacggtgctgcaggaacccgtccaggctgctatatggcaagcactaaaccactatgcttaccgagatgcggttttcctcgcagaacgcctttatgcagaaggcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagtgacagctccacaaccaaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcagaaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagctgaaagaatattctcagaggttagaaggattgagaattatagagttgaaggcatggagatctactctacaacactttggcatcttcaaaaagatgttgctctttcagttctgtcaaaagacttaacagacatggataaaaattcgccagaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaa

SEQ ID NO: 116167 - DNA, 3177 bp, Homo sapiens
  Payload ID: 2658
  Gene Symbol: CDC27
  Gene Name: cell division cycle 27
  Uniprot ID: P30260
  ENST ID: ENST00000531206
  CDS Start-End: 5-2497
gaggatgacggtgctgcaggaacccgtccaggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaagacttttcgtgttttacagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagtgacagctccacaaccaaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcagaaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagctgaaagaatattctcagaggttagaaggattgagaattatagagttgaaggcatggagatctactctacaacactttggcatcttcaaaaagatgttgctctttcagttctgtcaaaagacttaacagacatggataaaaattcgccagaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtgtttgcaagtgccagatggaacaataaaagacgttgcctataacagtgacttgattgccaaggaatgtaaattaccttaaacttgcagtatctcccataaacaaatgtaatgggcatattgggactcgtatgtaggaatcaaatatccctccatacagtgtactcttattcttggcaagaatgctttaatgtctaaccaagaattttaatttattcatcttgcttcaaa

SEQ ID NO: 116168 - DNA, 2579 bp, Homo sapiens
  Payload ID: 2658
  Gene Symbol: CDC27
  Gene Name: cell division cycle 27
  ENST ID: ENST00000527547
  CDS Start-End: 53-2524
ccgctacagggggggcctgaggcactgcagaaagtgggcctgagcctcgaggatgacggtgctgcaggaacccgtccaggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagtgacagctccacaaccaaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagctgaaagaatattctcagaggttagaaggattgagaattatagagttgaaggcatggagatctactctacaacactttggcatcttcaaaaagatgttgctctttcagttctgtcaaaagacttaacagacatggataaaaattcgccagaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttct

SEQ ID NO: 116169 - DNA, 514 bp, Homo sapiens
  Payload ID: 2658
  Gene Symbol: CDC27
  Gene Name: cell division cycle 27
  ENST ID: ENST00000574304
  CDS Start-End: 1-179
ttgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaatagttttgggattttgccattagaaaccccaagtcctggagatggatcctatttacaaaactacactaatacacctcctgtaattgatgtgccatccaccggagccccttcaaaaaagacttttcgtgttttacagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagtgacagctccacaaccaaggagaatagc

SEQ ID NO: 116170 - DNA, 548 bp, Homo sapiens
  Payload ID: 2658
  Gene Symbol: CDC27
  Gene Name: cell division cycle 27
  ENST ID: ENST00000576484
  CDS Start-End: 1-311
ctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagaccttctaatttaagtatactgctgctttatatatgccttgatgactttttgacaccttgatttcaacctcttctcagttttgggattttgccattagaaaccccaagtcctggagatggatcctatttacaaaactacactaatacacctcctgtaattgatgtgccatccaccggagccccttcaaaaaagtctgttgccagaatcggccaaactggaacaaagtctgtcttctcacagagtggaaatagccgagaggtaactccaattcttgcacaaacacaaagttctggtcca

SEQ ID NO: 116171 - DNA, 656 bp, Homo sapiens
  Payload ID: 2658
  Gene Symbol: CDC27
  Gene Name: cell division cycle 27
  ENST ID: ENST00000570818
  CDS Start-End: 1-261
ttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtc

SEQ ID NO: 116172 - DNA, 888 bp, Homo sapiens
  Payload ID: 2658
  Gene Symbol: CDC27
  Gene Name: cell division cycle 27
  ENST ID: ENST00000573502
  CDS Start-End: 1-341
caaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaaaccttttctggcagctgagaattttgaacttggtaaattgataaactaggaaactgattttatataacctaaatcctcaaactttagagggagagaaacacagttctgggagctgtgaatgtgatgaggaaaaaaattgatgaggcagctgaggagagaccctgaagtcaagagagtgctgcaaaggaaaggataattaataggctgaaagaatattctcagaggttagaaggattgagaattatagagttgaaggcatggagatctactctacaacactttggcatcttcaaaaagatgttgctctttcagttctgtcaaaagacttaacagacatggataaaaattcgccagaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatg

SEQ ID NO: 116173 - DNA, 716 bp, Homo sapiens
  Payload ID: 2658
  Gene Symbol: CDC27
  Gene Name: cell division cycle 27
  ENST ID: ENST00000571643
  CDS Start-End: 1-490
agggcatgagtttgtcttaactgaagaattggacaaagcattagcttgttttcgaaatgctatcagagtcaatcctagacattataatgcatggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtg

SEQ ID NO: 116174 - DNA, 583 bp, Homo sapiens
  Payload ID: 2658
  Gene Symbol: CDC27
  Gene Name: cell division cycle 27
  ENST ID: ENST00000573550
  CDS Start-End: 1-226
ttaccgagatgcggttttcctcgcagaacgcctttatgcagaaggcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgc

SEQ ID NO: 116175 - DNA, 781 bp, Homo sapiens
  Payload ID: 2658
  Gene Symbol: CDC27
  Gene Name: cell division cycle 27
  ENST ID: ENST00000575483
  CDS Start-End: 81-781
aaatgagcaggggctggccgggccggagccgctacagggggggcctgaggcactgcagaaagtgggcctgagcctcgaggatgacggtgctgcaggaacccgtccaggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgttcaaaataaaccaaaaactggtcgaagtttattaggaggaccagcagctcttagtccattaaccccaag

SEQ ID NO: 116176 - DNA, 594 bp, Homo sapiens
  Payload ID: 2658
  Gene Symbol: CDC27
  Gene Name: cell division cycle 27
  ENST ID: ENST00000570740
  CDS Start-End: 1-100
aataggaaagtgctgctgtttatttttaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaacc

SEQ ID NO: 116177 - DNA, 515 bp, Homo sapiens
  Payload ID: 2658
  Gene Symbol: CDC27
  Gene Name: cell division cycle 27
  ENST ID: ENST00000532893
  CDS Start-End: 90-248
ggtgagtttaaatgagcaggggctggccgggccggagccgctacagggggggcctgaggcactgcagaaagtgggcctgagcctcgaggatgacggtgctgcaggaacccgtccaggctgctatatggcaagcactaaaccactatgcttaccgagatgcggttttcctcgcagaacgcctttatgcagaagcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtctt

SEQ ID NO: 116178 - DNA, 1471 bp, Homo sapiens
  Payload ID: 2659
  Gene Symbol: CDC34
  Gene Name: cell division cycle 34
  Uniprot ID: P49427
  ENST ID: ENST00000215574
  CDS Start-End: 221-931
ggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgagaggcca

SEQ ID NO: 116179 - DNA, 1147 bp, Homo sapiens
  Payload ID: 2659
  Gene Symbol: CDC34
  Gene Name: cell division cycle 34
  ENST ID: ENST00000586283
  CDS Start-End: 1-440
acgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccgcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgagaggcca

SEQ ID NO: 116180 - DNA, 1062 bp, Homo sapiens
  Payload ID: 2659
  Gene Symbol: CDC34
  Gene Name: cell division cycle 34
  ENST ID: ENST00000606065
  CDS Start-End: 1-360
gcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgaga

SEQ ID NO: 116181 - DNA, 357 bp, Homo sapiens
  Payload ID: 2659
  Gene Symbol: CDC34
  Gene Name: cell division cycle 34
  ENST ID: ENST00000607527
  CDS Start-End: 1-324
tacttcaaggcgcgcctcaagttccccatcgactacccatactctccaccagcctttcggttcctgaccaagatgtggcaccctaacatctacgagacgggggacgtgtgtatctccatcctccacccgccggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctca

SEQ ID NO: 116182 - DNA, 1608 bp, Homo sapiens
  Payload ID: 2660
  Gene Symbol: CDC37
  Gene Name: cell division cycle 37
  Uniprot ID: Q16543
  ENST ID: ENST00000222005
  CDS Start-End: 55-1191
tgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgct

SEQ ID NO: 116183 - DNA, 537 bp, Homo sapiens
  Payload ID: 2660
  Gene Symbol: CDC37
  Gene Name: cell division cycle 37
  ENST ID: ENST00000589331
  CDS Start-End: 1-314
tcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgtgagtaacccccgcgccccatgccttcccggcgggccgtgtgtctcccccagccctgtgtcccaagtctctgaagccggctggtgaaagtgcccctccaaggcttctccaaggagtaaggggggtcgtgtcaccttggcacacacccacatatattgagcacctactgtatcccagtatccagcagataaatgctgagctttgagcgcatgtccttcgtgactgtcactgttactgtgactgagtccagcctcagtttccttatccaaaccacattttctctcaatatcagctcacaaaatgcgtggga

SEQ ID NO: 116184 - DNA, 966 bp, Homo sapiens
  Payload ID: 2660
  Gene Symbol: CDC37
  Gene Name: cell division cycle 37
  ENST ID: ENST00000588869
  CDS Start-End: 33-215
cgagccggagcgggctgggccgccaaggcaagatggtggactacagcgtgtgggaccacattgaggtgtctgatgatgaagacgagacgcaccccaacatcgacacggccagtctcttccgctggcggcatcagacagggccttgctttgtcaccctgagatggcagtggcgccatctcagctcactgcaacttccaccttccgggctcaagtgatcctcctacttctgcctcctgagtagctgggaccacaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggtgagtggggcttgtgggttatggggggcaaggtcgaggcaggccctttgcctccagggccctccagcaccttgccagcatcttcccacaggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagatta

SEQ ID NO: 116185 - DNA, 1389 bp, Homo sapiens
  Payload ID: 2660
  Gene Symbol: CDC37
  Gene Name: cell division cycle 37
  ENST ID: ENST00000593124
  CDS Start-End: 329-1389
caccggcgcggtacctgcagcgggcggcggcagagtgtgtgggatctcctgtctgtgcgtcggaggatagtgatggaagacaccctgtggcggataccgcagctgccggcccaccgctctatacatcgctgcctcttctaaagcgcttctgccagaggtaaactgaggaaggtcccaggtagccgcggagcgcacccccgtgcccttttcagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaaggcccatgcccacgctcccgccaccttgatgctcatggcttcgtcaccacctccgccgtggatgggatgggcgctgcgaccacggcccgcccggccgcgctcgaggcgctccgcagccttgccccagcccactccccctctcaccctaccacagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctga

SEQ ID NO: 116186 - DNA, 587 bp, Homo sapiens
  Payload ID: 2660
  Gene Symbol: CDC37
  Gene Name: cell division cycle 37
  ENST ID: ENST00000589625
  CDS Start-End: 1-554
attacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccag

SEQ ID NO: 116187 - DNA, 728 bp, Homo sapiens
  Payload ID: 2660
  Gene Symbol: CDC37
  Gene Name: cell division cycle 37
  ENST ID: ENST00000589629
  CDS Start-End: 39-728
gccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatg

SEQ ID NO: 116188 - DNA, 3502 bp, Homo sapiens
  Payload ID: 2661
  Gene Symbol: CDC37L1
  Gene Name: cell division cycle 37-like 1
  Uniprot ID: Q7L3B6
  ENST ID: ENST00000381854
  CDS Start-End: 203-1216
tttcttccgccgtccgccggtggcgaggcccaggctgtcgccgggtgtgcagcggcgtcgcggccagtagagggattctgggtaacggcccggacccccggctgggcttctggctcggcgcagcaggttccattcacgccaagtctgttggcagtggcagttgtagggccaagggcggttgtaggacccggagcagccggacatggaacaaccgtggccgcctccgggaccctggagcctccctcgggccgagggtgaggctgaggaagagagtgacttcgacgtgttccccagttctccccgctgcccgcagctgccaggcggcggcgcccagatgtatagccatggaattgaattggcttgccaaaagcagaaagagtttgtgaagagctctgtggcgtgcaaatggaatcttgctgaagctcaacagaaacttggtagcttagcactgcataattctgagtccttggatcaggagcatgccaaagcacaaacagcagtatcagaactgaggcaacgggaagaagagtggcgacagaaagaagaagctctagtacaaagagagaagatgtgtctgtggagcacggatgccattagcaaggatgtttttaataagagttttattaatcaagataaaagaaaagacacagaagatgaagataaatcagaatcatttatgcaaaaatatgagcaaaaaatcagacattttggtatgttgagtcgatgggatgatagccagagatttttgtctgaccatccataccttgtatgtgaagaaactgctaaatatcttattttatggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgttcggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcttttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtagttggtaatgtactttactaaataagttggggggtacaatttttaaaagtcttaactcttaaatacttgactttcggcaccatcagttaaatccttgactataatacaaatttgatatatacattacatttaccctcaaattattctcaaaactatattccttagaatttgattttaccctgctgactttaagagttataataatatcaaatgtgatgagctaatatagattttctttttaaataagaataacttcaagctcactctttcttaacatagtctgggatctctcagggagtaagttttaaaagaatactaatggcttgtaagaacaaacaggaataataatctgatttttaaatttgtagttattttactcatgttgccttttaatttttgttattttggtttattttttgatgtagccttttaaaaaaggagtcttaaaaatgattttttttttaaaggcaagagaaatcttgtagtgctaactgccttgagctgccaattacctatttctgagaatttggtgactcttattggtaatgatggcatttacaacatttggcatttcccctttttcagctcagttaccatagaatacttccaagctttactacttcctctgtaagtcatttcagttatgccaggatatttgatgattttgtttatgtagaattaggtaacaaagccaattatgctatccttattattgaaggattaatcttatgacttaacataagctttggttatatttgggtgtagtctttggctaagtacccattaaggctagtagcaaacacttggaaggtggctaactgggactgggaatacgtgtctcaacttgagaaaccaaatagtgcgaagggactcagggtggccagacctgtgaccttggcctcatttgtatcttgttttcgctgaggtgatcagacacttagtaccctagaaatggactggaattattgaatcttcttctgtaacatcacaatcttcctggttttcagaataaacgtttttgtgcttttgatataaatatatactctataataaaatgtttgactaatttatatagtagtgtttgtcagcctgtactttttttttttttaaacccatgacctagtcgtagacatttttttctttttgttctgttctgaagcaagctcttatttttccctttctaccaaattgagagaatgggcagacacaggagccatattcctagtttcacagaaatgttacttgaattattattttcccttctttcccaggatttgcctgtaagcattcaaattgttttgaatttcattttgccttctctaagttagaggtatttaatgactgaagactggcaggagagaaagtatcaacaaactgagtaaactattcttgaggggcactgaaaagatgttctttgaaacttgatttatatatttttacttgcaaaagaatatactgtgttttgagtatgaaagtgtgattgggtctgttgtgggaaccactgactgatgccataatttgcacttaaaggctataaattacatagttagccgtactttagtactagaaacagtaaattgacatccttgaactaattcctaccttttttttgtttctgaagaaataaagagtatattaagcaaagggataatttatatttcaggttggacaatttaccctaaacaaattaaaccatggaaagtgcaaacacatgaatgaaacatttttttacatcaaagtatcatcaaagattcttgtttcatttgataaaattaatatttgaataaaaaaatttttaaatcaa

SEQ ID NO: 116189 - DNA, 1244 bp, Homo sapiens
  Payload ID: 2661
  Gene Symbol: CDC37L1
  Gene Name: cell division cycle 37-like 1
  ENST ID: ENST00000381858
  CDS Start-End: 210-1136
ccgactatttcttccgccgtccgccggtggcgaggcccaggctgtcgccgggtgtgcagcggcgtcgcggccagtagagggattctgggtaacggcccggacccccggctgggcttctggctcggcgcagcaggttccattcacgccaagtctgttggcagtggcagttgtagggccaagggcggttgtaggacccggagcagccggacatggaacaaccgtggccgcctccgggaccctggagcctccctcgggccgagggtgaggctgaggaagagagtgacttcgacgtgttccccagttctccccgctgcccgcagctgccaggcggcggcgcccagatgtatagccatggaattgaattggcttgccaaaagcagaaagagtttgtgaagagctctgtggcgtgcaaatggaatcttgctgaagctcaacagaaacttggtagcttagcactgcataattctgagtccttggatcaggagcatgccaaagcacaaacagcagtatcagaactgaggcaacgggaagaagagtggcgacagaaagaagaagctctagtacaaagagagaagatgtgtctgtggagcacggatgccattagcaaggatgtttttaataagagttttattaatcaagataaaagaaaagacacagaagatgaagataaatcagaatcatttatgcaaaaatatgagcaaaaaatcagacattttggtatgttgagtcgatgggatgatagccagagatttttgtctgaccatccataccttgtatgtgaagaaactgctaaatatcttattttatggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacaggctccaagattttaagaccagctttagccagtttaatctgttgtctacattgtgagaaggaaagtcttattcaaaagacaatgtgaggagagtcctatatttagttttaaacctcataaagtg

SEQ ID NO: 116190 - DNA, 3848 bp, Homo sapiens
  Payload ID: 2662
  Gene Symbol: CDC40
  Gene Name: cell division cycle 40
  Uniprot ID: O60508
  ENST ID: ENST00000307731
  CDS Start-End: 25-1764
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgt

SEQ ID NO: 116191 - DNA, 1977 bp, Homo sapiens
  Payload ID: 2662
  Gene Symbol: CDC40
  Gene Name: cell division cycle 40
  ENST ID: ENST00000368930
  CDS Start-End: 25-1644
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagagtccctcagagctttcagaatctgaaggaggtgactgcaggtccccaggaggggtgaggaggatggcaagtgggtgaaggtccagacctcaactcaagagcagctcccctttgatctccttgacatatttggaatccctcacaaatttgcatttgggaaaagagctctcctgcttaaaaaaaatatgaaagcctctatcaataatttattcttaacagcttttgtaatgatttaatttatttaatcagtcctccttctggtggccatatagatattttcccaaatggatgatgttacaaactgatgttatcaacaaactgggcaactaagtttgtgtgtgtgttctgtcattttgtaaaacagaattctgaaaagaagtgttgtaaatga

SEQ ID NO: 116192 - DNA, 3933 bp, Homo sapiens
  Payload ID: 2662
  Gene Symbol: CDC40
  Gene Name: cell division cycle 40
  Uniprot ID: O60508
  ENST ID: ENST00000368932
  CDS Start-End: 102-1841
cgcgctgcacgctgggagtgcaggaccgcgaggcctcaaggacctgggagcctcttcttcttccgccctggcagggtctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgtagaaagtg

SEQ ID NO: 116193 - DNA, 1452 bp, Homo sapiens
  Payload ID: 2663
  Gene Symbol: CDC42
  Gene Name: cell division cycle 42
  Uniprot ID: P60953
  ENST ID: ENST00000315554
  CDS Start-End: 105-680
ggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagagaggtctgaagaatgtgtttgatgaggctatcctagctgccctcgagcctccggaaactcaacccaaaaggaagtgctgtatattctaaactgttttctccttcccttctttgctgctgcttcctgtcccactactgtagaaagatcgtttaaaaacaaaggaataaaaccatcctgtttgaaagcctctgcgtctttttactcaccaccttagagcaacctctgtattagtttttgatcaagaatgcaatatcatataaattttttgtgatcagtagtcaagttggacttgttttaacgttctgctgcttgagttgcctgatgctcagagctttttggtttggattactattgcaaaagggaacttggtctggctttaagaatgtcctcttggagaaaataacaagagttttaacacttctagatcttagttctagatggagaaagtaacacaaacatcattttactcttatgatcaattgttaattgtaattgcatgacaaaccttatggaaaaggggtgacctagtagagtgtaatggggaagggaggattcttttctggttttcctttgtgcggtgaaactttgtgttgctgttgctttggctgtctgtgctgtagtggagtatttgtcagtctggggtggggaagatattgatgtatctgctactgctttatgagttcatttgttacattatcttttaagaataacatccatttaaacagttgacttacagtttgttaatgctgagatgtaaagctgccacctttatattttcctgcttctgattttattgtgagggaaatatacaattgtggttaccttcaaattttgaaattaaaaatatacaaccgtttgtat

SEQ ID NO: 116194 - DNA, 2256 bp, Homo sapiens
  Payload ID: 2663
  Gene Symbol: CDC42
  Gene Name: cell division cycle 42
  Uniprot ID: P60953
  ENST ID: ENST00000344548
  CDS Start-End: 252-827
gtcaggtgcgtgcccctgtccggcagccgaggagaccccgcgcagtgctgccaacgccccggtggagaagctgagacggagtctcactgtgttgcccaggctggagtgcagtggcgccatcttggctcactgcagtgcgcctctgccccccgagttcaagcgattctcctgcctcaggctcctgagtagctgggactacaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtgttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcacaa

SEQ ID NO: 116195 - DNA, 2274 bp, Homo sapiens
  Payload ID: 2663
  Gene Symbol: CDC42
  Gene Name: cell division cycle 42
  Uniprot ID: P60953
  ENST ID: ENST00000400259
  CDS Start-End: 293-868
acttccgcgggcacccaactgtgcgtctcctgcgcgctgacgtcaggtgcgtgcccctgtccggcagccgaggagaccccgcgcagtgctgccaacgccccggtggagaagctgaggtgagtgcggggcccgaggttccccgcgggagctgccaccctaccttcccatccccgccgtctccgtcctctcccagtcctcggggacaccccgtctgcgggatcgtggggggcccgggagcacgggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtgttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtatt

SEQ ID NO: 116196 - DNA, 597 bp, Homo sapiens
  Payload ID: 2663
  Gene Symbol: CDC42
  Gene Name: cell division cycle 42
  ENST ID: ENST00000411827
  CDS Start-End: 188-597
cgcggcggggcggtggcaggagggcagctcgctggctgctcgcggcggtgcctgtccgagctcccctccgcgccggccgcgtcctctgggcggggtggccccgagccacggcctccaggctgctcttcctttcggaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctat

SEQ ID NO: 116197 - DNA, 1976 bp, Homo sapiens
  Payload ID: 2664
  Gene Symbol: CDC45
  Gene Name: cell division cycle 45
  Uniprot ID: O75419
  ENST ID: ENST00000263201
  CDS Start-End: 144-1844
aaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttaggctccgtcccc

SEQ ID NO: 116198 - DNA, 1693 bp, Homo sapiens
  Payload ID: 2664
  Gene Symbol: CDC45
  Gene Name: cell division cycle 45
  Uniprot ID: O75419
  ENST ID: ENST00000404724
  CDS Start-End: 32-1594
cgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccatttttta

SEQ ID NO: 116199 - DNA, 2090 bp, Homo sapiens
  Payload ID: 2664
  Gene Symbol: CDC45
  Gene Name: cell division cycle 45
  Uniprot ID: O75419
  ENST ID: ENST00000407835
  CDS Start-End: 257-1957
actacccagactgcctctgcttcagccatcgaggactcgggcggaactaagctacaaatccttcttcaaaccacaccaaaaacctattgcaaacgtaaatgctgccccattggaaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttaggctccgtcccca

SEQ ID NO: 116200 - DNA, 577 bp, Homo sapiens
  Payload ID: 2664
  Gene Symbol: CDC45
  Gene Name: cell division cycle 45
  ENST ID: ENST00000428937
  CDS Start-End: 1-290
ctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggaggataatttattgagtttagaacctttgggccagtggctctgggagtgaacctgtggccgctgcattggagaagagctccaggttgttcgccggtcccatgagtgacaggacagccccaaggtctcccagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaata

SEQ ID NO: 116201 - DNA, 552 bp, Homo sapiens
  Payload ID: 2664
  Gene Symbol: CDC45
  Gene Name: cell division cycle 45
  ENST ID: ENST00000438587
  CDS Start-End: 76-552
agccatcgaggactcgggcggaactaagctacaaatccttcttcaaaccacaccaaaaacctattgcaaacgtaaatgctgccccattggagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggagg

SEQ ID NO: 116202 - DNA, 2072 bp, Homo sapiens
  Payload ID: 2664
  Gene Symbol: CDC45
  Gene Name: cell division cycle 45
  Uniprot ID: O75419
  ENST ID: ENST00000437685
  CDS Start-End: 144-1940
aaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagtggctctgggagtgaacctgtggccgctgcattggagaagagctccaggttgttcgccggtcccatgagtgacaggacagccccaaggtctcccagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttaggctccgtcccc

SEQ ID NO: 116203 - DNA, 568 bp, Homo sapiens
  Payload ID: 2664
  Gene Symbol: CDC45
  Gene Name: cell division cycle 45
  ENST ID: ENST00000455750
  CDS Start-End: 232-568
agaggtgacgcttctttgggggcgggctggagttttctggccgtgaatggcagagcgctaatggccgcctccaatgtggcccaatcagaaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgata

SEQ ID NO: 116204 - DNA, 6423 bp, Homo sapiens
  Payload ID: 2665
  Gene Symbol: CDC5L
  Gene Name: cell division cycle 5-like
  Uniprot ID: Q99459
  ENST ID: ENST00000371477
  CDS Start-End: 300-2708
tttcttccattctgttttggacatgcgcggggcgtaaggcgctttggccagagtggtttgatggttttgtgttagtcttcctgcagctgagcttccacaagacactttttccctttcagccacccaatatctcgcgagacttgctattctgcgccccctcccaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttgttaatatcactttaaagaaggtctcttgtctgccagctacttaaataatttatgggtcagggcttaaaagatttaacttccttgccccattattttcttataagtattttttgacaaaggcattttaaaagttaatttcaagaaggccatcaaacttaaagctctatgtttagcctaagaagtcagttacatcagtgtagaatttggggaatggatagaggtggagatatttaattttatataattcatataaattgatttagttacagtatcagttggctacaagctcattatagactagcaatgttttgacatcaccaaaaacgtttgcccagtcttagaatactagggactataggaagggaagggattcattcattcattcgatattgaatgtataccctgtgccagagtcttagagagagaacaacaaacaaaataggcctagttcttgtttagtagagcttatagtcttttgagaatgacagacaattaaaatccaaatgtttatttggtgattcttatgtgtcagacacttaagtgttgggagataagcagttattaagacagagttcttgctctcatggaggtgacattagtggggaggagatactaagtatgtccagggaaagtatcagaccatgagttttagattctgtggaggaaattaaagtagggtgattatgagatagtgaatgagtggctattttagactggacgatcaaagagacctcttggaaggcagctatgctcaccactataccactgcactgtgccgcaccgtaccactataagctgcacggccaaagagacctcttaaagaagtaacatttaagataacatgtgattgacattttagaatgggctatccttgtgagattcaaggaaagaacatcctaggtggagtgaatagcaaacataaagcctcttttgtatgtttgaggaacaaaaaggacaatgcagctagagtgtcaagaatggcatttctgtatataagacctcgttgtatagagccacataaataaggctataataaggaatttggatcttactttaaatatgataagaatcgatgagaagatctaagcaaaggaatgacatgatcagatttggttttagaaacatcactatctccttagtgtgtaaaatctcaccaggctggagatagggaagccagtccaattaggagcctgatgcagtgatccagacaaaaaaataatagtgattctaactagagtccaggtaatagtagtggagatatgtggagagacatgataggtatatacttaatagtcttatcagacgataaattgatattttcctggtgtgtagtcacttaattcaaatacttttttcagtaagttctgggttttctaggaaaaacttcagtatcatcagtgaataatgatagtgtttcttctgatagttttatttcacttttattgcatgttttgttatctgaaatgtttaggacaatgttaacaataatgatgttagacatttttttttcttattttaatgggaatgtccatagttttaagtttgctgttgggagttagatagtctttatctgaaagacagtgtctctcttttagtttttaaagagtttgaattagaaatggctctggaactttaaacagtataccatttgggcatctattaaagcattcatataattgttctcatttgatgttttgatgaggtatattaatagattttcccacattaaatcatctttgcactcctggaatcaggtagattaatttttaaaagaaattttaaaggatttatagtttatttgcactttttgtagacttgaattatatggatttaaaagttgatctaatattaataaaggctcactttgttttcaaaatttgaagtaattcacatacttatagcctaaaaaaatcggcaggaattacaaaatttcaaaactggcacattgtaaactgcatatgcatttgccaggtagtggtgccacttgaaatggtgaacagacacactgttatcctttgtcagtatcctgtaaagcccaggattctttaccagcaccatacagcgattttggtgactattttaacattcacactgaggccaggggtggtgagtcatgcctgtaatcctagcactttgggaggccaaggtgggaggatcatttgagctcaggagttcaagattagcctgggtaacatagtgagaccctgtctctattaaaaaataataataaaaataacattcacattggtattgttcactaaggtattggttgttaaggcattcattaaggtattgttaaaacttgtgttaagcatgttaaagtctcagtaactttgggatagaaataaaatgtgataaaaagctgaaagaaaccaccacaagggagagtcctttttgaaatattagagacataatgctgtctaataaaaaacgacatcaaagaaaaactacactacagtgactgcagacttaatgttggccaaccatgcatcctccctagaaatgcatttgaatttgatttactaatcttttatttaggaaatttacatttttacattagtgagattggtcttttgggctattgtacttttttttttttttttttgagatggagtcttgctctctcacccaggctggagtgcagtagtgcaatcttggcccactgcaacctctgcctcctgggctcgagtgattctctgcctcagccttccaagtagctgggactacaggcatgtgccaccgcacctggctaatttttgtgtttttagtagagatggggttttgctatgttggccaggctggtcttgaattcctgacctcaggtgatccacctacctcggcctcccaaagtgctagaattacaggtgtgagccaccatgcccagcctggttattgtattttgatattgggattttgctagctctctaaagtaaataggataactgtatatctttttctgtgcattaagcagttataacatgggaatgatttgttcatgaaaggttgaaagtctgtacttacagaacttttgagttcacagtgctttctggaaataatttctttataactgtcagtttcttttgtgactattatgttacctatttttaaatttaagcaactttaaattaaaaaaattgtttttaaaatat

SEQ ID NO: 116205 - DNA, 4810 bp, Homo sapiens
  Payload ID: 2666
  Gene Symbol: CDC6
  Gene Name: cell division cycle 6
  Uniprot ID: Q99741
  ENST ID: ENST00000209728
  CDS Start-End: 472-2154
gctttacccagagtcgccctgccgcaatcgcgcgtctttccaccgaggccccggatgtagattccctcccccgttcagtggtcgtggcctcacagcgactctaagacttggggctctctcattggctgtaactcttccactggattggtagcaaaaaaagaggcggtgcccaaggcgaaaggctctgtgactacagccaatcagaatcgaggccgggctttggcgggaggtgggaacgctgtggccattcggatttggcgcgagcgcggctggagtttgctgctgccgctgtgcagtttgttcaggggcttgtggtggtgagtccgagaggctgcgtgtgagagacgtgagaaggatcctgcactgaggaggtggaaagaagaggattgctcgaggaggcctggggtctgtgaggcagcggagctgggtgaaggctgcgggttccggcgaggcctgagctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatcagctgacaattaagtctcctagcaaaagagaactagccaaagttcaccaaaacaaaatactttcttcagttagaaaaagtcaagagatcacaacaaattctgagcagagatgtccactgaagaaagaatctgcatgtgtgagactattcaagcaagaaggcacttgctaccagcaagcaaagctggtcctgaacacagctgtcccagatcggctgcctgccagggaaagggagatggatgtcatcaggaatttcttgagggaacacatctgtgggaaaaaagctggaagcctttacctttctggtgctcctggaactggaaaaactgcctgcttaagccggattctgcaagacctcaagaaggaactgaaaggctttaaaactatcatgctgaattgcatgtccttgaggactgcccaggctgtattcccagctattgctcaggagatttgtcaggaagaggtatccaggccagctgggaaggacatgatgaggaaattggaaaaacatatgactgcagagaagggccccatgattgtgttggtattggacgagatggatcaactggacagcaaaggccaggatgtattgtacacgctatttgaatggccatggctaagcaattctcacttggtgctgattggtattgctaataccctggatctcacagatagaattctacctaggcttcaagctagagaaaaatgtaagccacagctgttgaacttcccaccttataccagaaatcagatagtcactattttgcaagatcgacttaatcaggtatctagagatcaggttctggacaatgctgcagttcaattctgtgcccgcaaagtctctgctgtttcaggagatgttcgcaaagcactggatgtttgcaggagagctattgaaattgtagagtcagatgtcaaaagccagactattctcaaaccactgtctgaatgtaaatcaccttctgagcctctgattcccaagagggttggtcttattcacatatcccaagtcatctcagaagttgatggtaacaggatgaccttgagccaagaaggagcacaagattccttccctcttcagcagaagatcttggtttgctctttgatgctcttgatcaggcagttgaaaatcaaagaggtcactctggggaagttatatgaagcctacagtaaagtctgtcgcaaacagcaggtggcggctgtggaccagtcagagtgtttgtcactttcagggctcttggaagccaggggcattttaggattaaagagaaacaaggaaacccgtttgacaaaggtgtttttcaagattgaagagaaagaaatagaacatgctctgaaagataaagctttaattggaaatatcttagctactggattgccttaaattcttctcttacaccccacccgaaagtattcagctggcatttagagagctacagtcttcattttagtgctttacacattcgggcctgaaaacaaatatgaccttttttacttgaagccaatgaattttaatctatagattctttaatattagcacagaataatatctttgggtcttactatttttacccataaaagtgaccaggtagaccctttttaattacattcactacttctaccacttgtgtatctctagccaatgtgcttgcaagtgtacagatctgtgtagaggaatgtgtgtatatttacctcttcgtttgctcaaacatgagtgggtatttttttgtttgttttttttgttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtagagacagggttttaccatgttggccaggctggtcttgaactcctgaccctcaagtgatctgcccaccttggcctccctaagtgctgggattataggcgtgagccaccatgctcagccattaaggtattttgttaagaactttaagtttagggtaagaagaatgaaaatgatccagaaaaatgcaagcaagtccacatggagatttggaggacactggttaaagaatttatttctttgtatagtatactatgttcatggtgcagatactacaacattgtggcattttagactcgttgagtttcttgggcactcccaagggcgttggggtcataaggagactataactctacagattgtgaatatatttattttcaagttgcattctttgtctttttaagcaatcagatttcaagagagctcaagctttcagaagtcaatgtgaaaattccttcctaggctgtcccacagtctttgctgcccttagatgaagccacttgtttcaagatgactactttggggttgggttttcatctaaacacatttttccagtcttattagataaattagtccatatggttggttaatcaagagccttctgggtttggtttggtggcattaaatggcaatttgtgactgagacaccagagggcacccttataacattgactactttgaaaggggatgcttgaggctgaggtagttttgagggaaagggggaagttctagtttgatttgtttgggagattgctgtcctttcataactgaagcaaatgcttgaaatgtaaaccatgtgtgatacgaatgatctgagagccagtgaccaagtctgcttttccctgagctctcctgctgccgcctctacctttctgacatggccttccatttggaacttgatatgtgtacaagtgatctgttggccactgtttcattcatcctgaccactgtatccgtgtaatgtgatctgagctacaacaggtggtatgggatagaggcaaggaaagcagagagagccctctgaaatgaacactacccactggtgtgtgtagcacatgatagtctgtaggcatgagtctgaatgttgttctcacactcctttactagagtattcgttccctctgaaggtagtttgaacatggaaacacagttctatacctagaaggttggaaagtgtctgggactataagggttaacatgcataattgcaaagattgtccgaaggctgatggaaagcagagactgaatgggattgagaacagatgcgaagcttgatttaaattacattttattggatgctgcagccttaagagacgtgactgctttacagtttgtttccacactgtgggcagctgctgtctgttctgtgtccacagtaggatcctgcccaataaggagcagcctccccacctcattgtgtttgaggcttggcgccttcctcttaactgtagggcttgagtcaggaacatggcttgactcgcagtggggctgctatgtatcctccctggcttccagccaaaatcacattggtagattcaaaggggccaaatttctttcccctctatctttccctttcccctggttttggaaatagagttttctgtctactgatttgttagtttccttttcttctcccctcactgtcaatttctaggtcattgctgctcttaagactttagcagttggaacagggttggttctgtcaatgatgcatgaagcagacttagtgtccctgcttggcttctgctgcccttgtgggagcaaaagctgatatatgtttgtcagtaaagtcttaagtgtaattcagactgctgaggaagaaagccctttccttgctggcttttctccctgaagctgagagcttcaggaaggtggtaggagttttagtgggatgggatgggatgggcttgtggttagcagtttttgccaggatcataggctgcttcacttagagtagtggcaaagatgctgacctacattcttccttttgaaggtgatggagtgtgtgtctatatcctggtttatctctctcccccaccccaaggaagctgattaagcttccatagagtgttgggtgttgccatggaaagagcatagacaaaataaattgtgtgtttcaacccca

SEQ ID NO: 116206 - DNA, 541 bp, Homo sapiens
  Payload ID: 2666
  Gene Symbol: CDC6
  Gene Name: cell division cycle 6
  ENST ID: ENST00000577249
  CDS Start-End: 240-541
gtttgctgctgccgctgtgcagtttgttcaggggcttgtggtggtgagtccgagaggctgcgtgtgagagacgtgagaaggatcctgcactgaggaggtggaaagaagaggattgctcgaggaggcctggggtctgtgaggcagcggagctgggtgaaggctgcgggttccggcgaggcctgaggtgaagtgaagggaaaagagctgagctcgctggaggtctgagctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatca

SEQ ID NO: 116207 - DNA, 696 bp, Homo sapiens
  Payload ID: 2666
  Gene Symbol: CDC6
  Gene Name: cell division cycle 6
  ENST ID: ENST00000580824
  CDS Start-End: 150-696
ctggagtttgctgctgccgctgtgcagtttgttcaggggcttgtggtggtgagtccgagaggctgcgtgtgagagacgtgagaaggatcctgcactgaggaggtggaaagaagaggattgctcgaggaggcctgggctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatcagctgacaattaagtctcctagcaaaagagaactagccaaagttcaccaaaacaaaatactttcttcagttagaaaaagtcaagagatcacaacaaattctgagcagagatgtccactgaagaaagaatctgcatgtgtgagactattcaagcaagaaggcacttgctaccagcaagcaaagctggtcctgaacacagctgtcccagatcggctgcctgccagggaaagggagatggatgtcatca

SEQ ID NO: 116208 - DNA, 584 bp, Homo sapiens
  Payload ID: 2666
  Gene Symbol: CDC6
  Gene Name: cell division cycle 6
  ENST ID: ENST00000473555
  CDS Start-End: 230-584
gtgtttataacagcgcccttccacgtagtaggtagacaacaaatgtcagctgttcttgcatagatttggatgtgaagcaaaagtgaatgctaaaataagtgtgataacataattaggaaataagtgttaatcatcagtataaataaattccatgttagttattttctcttcactttcacatattgactagttgtcctcttattttttttaatctagctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatcagctgacaattaagtctcctagcaaaagagaactagccaaagttcaccaaaaca

SEQ ID NO: 116209 - DNA, 3173 bp, Homo sapiens
  Payload ID: 2667
  Gene Symbol: CDC7
  Gene Name: cell division cycle 7
  Uniprot ID: O00311
  ENST ID: ENST00000234626
  CDS Start-End: 120-1844
ttggagacggcgacccaggcatctggggagccacagaagtcgtactcccttaaaccctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacaaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaatttgaatgctcttgaatttgtatattcaataaagttatccttttatatttttta

SEQ ID NO: 116210 - DNA, 3313 bp, Homo sapiens
  Payload ID: 2667
  Gene Symbol: CDC7
  Gene Name: cell division cycle 7
  Uniprot ID: O00311
  ENST ID: ENST00000428239
  CDS Start-End: 260-1984
atctggttcggtctctggcccgagggaagccggtccttcccggctgagctcgcggccagcgctggccggcggattcccattcattcacccttctcctcctccgcccagtactcgtggccagggtcgtatcagttctccgtcaacttgcttggggccttggacgagcctcctggcgcttcctgtcagtggcgaaaagctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacaaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaatttgaatgctcttgaatttgtatattcaataaagttatccttttatatttttta

SEQ ID NO: 116211 - DNA, 701 bp, Homo sapiens
  Payload ID: 2667
  Gene Symbol: CDC7
  Gene Name: cell division cycle 7
  ENST ID: ENST00000426137
  CDS Start-End: 230-701
cggtccttcccggctgagctcgcggccagcgctggccggcggattcccattcattcacccttctcctcctccgcccagtactcgtggccagggtcgtatcagttctccgtcaacttgcttggggccttggacgagcctcctggcgcttcctgtcagtggcgaaaagctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatata

SEQ ID NO: 116212 - DNA, 4969 bp, Homo sapiens
  Payload ID: 2668
  Gene Symbol: CDC73
  Gene Name: cell division cycle 73
  Uniprot ID: Q6P1J9
  ENST ID: ENST00000367435
  CDS Start-End: 185-1780
cggcggcctgggtggctactgcccctgctgctgtcgtaggcgaggacggctgttagtgctgctgctgttggttcgtcgcggcggcgaaggaggaggaggaagagggcgaggcgacaagagaagaaggaggcaggcgcggcggcagcggcggcgccccgagccggcggaggcgaggggggggaagatggcggacgtgcttagcgtcctgcgacagtacaacatccagaagaaggagattgtggtgaagggagacgaagtgatcttcggggagttctcctggcccaagaatgtgaagaccaactatgttgtttgggggactggaaaggaaggccaacccagagagtactacacattggattccattttatttctacttaataacgtgcacctttctcatcctgtttatgtccgacgtgcagctactgaaaatattcctgtggttagaagacctgatcgaaaagatctacttggatatctcaatggtgaagcgtcaacatcggcaagtatagacagaagcgctcccttagaaataggtcttcagcgatctactcaagtcaaacgagctgcagatgaagttttagcagaagcaaagaaaccacgaattgaggatgaagagtgtgtgcgccttgataaagagagattggctgcccgtttggagggtcacaaagaagggattgtacagactgaacagattaggtctttgtctgaagctatgtcagtggaaaaaattgctgcaatcaaagccaaaattatggctaagaaaagatctactatcaagactgatctagatgatgacataactgcccttaaacagaggagttttgtggatgctgaggtagatgtgacccgagatattgtcagcagagagagagtatggaggacacgaacaactatcttacaaagcacaggaaagaatttttccaagaacatttttgcaattcttcaatctgtaaaagccagagaagaagggcgtgcacctgaacagcgacctgccccaaatgcagcacctgtggatcccactttgcgcaccaaacagcctatcccagctgcctataacagatacgatcaggaaagattcaaaggaaaagaagaaacggaaggcttcaaaattgacactatgggaacctaccatggtatgacactgaaatctgtaacggagggtgcatctgcccggaagactcagactcctgcagcccagccagtaccaagaccagtttctcaagcaagacctcccccaaatcagaagaaaggatctcgaacacccattatcataattcctgcagctaccacctctttaataaccatgcttaatgcaaaagaccttctacaggacctgaaatttgtcccatcagatgaaaagaagaaacaaggttgtcaacgagaaaatgaaactctaatacaaagaagaaaagaccagatgcaaccagggggcactgcaattagtgttacagtaccttatagagtagtagaccagccccttaaacttatgcctcaagactgggaccgcgttgtagccgtttttgtgcagggtcctgcatggcagttcaaaggttggccatggcttttgcctgatggatcaccagttgatatatttgctaaaattaaagccttccatctgaagtatgatgaagttcgtctggatccaaatgttcagaaatgggatgtaacagtattagaactcagctatcacaaacgtcatttggatagaccagtgttcttacggttttgggaaacattggacaggtacatggtaaagcataaatcgcacttgagattctgaattatttggctcctccatttctggaaattgagactcaagctttatgaatttatcaagaacttaaaaatgaagaaggtcacagattgatcttttataagaccttatttgatgctttgtgcttcaaggagatgatacctgtcatccatataagcaaactttttggcttacaactatttttttaatattagccttctagtctgtaatggaaattgtatattttgatagaagttttttctccattggttaaattagcattacttaaaatttgtttctttagaaaataaatgcaggttataaatgtgtgtatatttagagattataaggctctctgagccatcttctgatttttcattgctctataattctttttactgaaaatactatgttatgaatggtattaaattttagtctctggaacatccaaaaccaagcaaagggatgtgactattttgaatgaatcagaatgtcaacttgtatgtacactatatctacacttactcattatttaaaaagaataatgaaaaatctagatcaattcttcaatttgattgaactgttcagccttttcaagatttctttatttacaaatgattacatttaaatgaatgtacattcttctcactgactttggtgattttgaaacctagaatgatgtgtttctatctgtaatatctttccatttgaaaaaaatctcaaaacacagattaaaaccacaataggctgtagtattttttattttgggagccagagtatgatttgggggaagaatatgtatcagccctattgcagtataactttaagctccttttctctttagtccacttttgattgtaatttttatggtataggattttgaatcttctattttaggcttgtcagtcttggagttcttatcttccattatccctaaatattgataaactcccaggcaccaaagaaaacatttgcttaattgtctgaaaagaaacaagagaaaaacactggtatttttatgtctgtattcaatatggtataaaatataaaaactatattttaacttagtgaaatattttactatttctctacttcagacaaaatgttgcatccaaggtacatcaagtgaccatttgccttgaaccttgatttcactttgttttttttttttccttaaaggcaactaggaagctttactttcctaaagtgtttttgccattggaatttttgctgatcacagtcttatgtcatttttttctctgtttttattcccagcaattttctcctaggttaacatatttttggtgaacgtttaggcctttcataggtattaagctgacattatctagcttcttaatgaaatttaacactgtcacaaaaatgagaagttattattttttaagtgatcacatagttcataccactagtaactagaaaagatatttattcacatgatatttacaaggctcttcagaagggaacagtcagcattttaaattactagattttagcatacttaacaaggtttgaacagattctacccctattttcctccctttttagcgtcttctttccttaaagataaaagaaaactcaaatttgtttacattaggctttcttagcatataaatatatttccaaaataaattacatgttgtgtaaactttctccatgatgaaatagtcaaggaccagaatctgtaatatttttatgtaagattacttgtcaagactactacaagtcagtatgaactaccttcccataaagatttttggtatttgtacttatttatgaactttacttgagacagaatatggttaaaattaggaacatctactttgaatgaggtttatttttctattttgaatttgccttatgtatattcaaaggcttatggaaatactgtaaaggaacattaggaaaaggacaaataggctataaccatctatcttaaaatcagacccttagtataagcacctctttttcttttcctctttgacaatttagtctcttatttaggtccatgtaattaatttcattccattattttttagctgtttattctaaaaaacaaaaattttcagccactcccatttattctcccatgacatggtcctatatagcagtacttaacacagtgccttgcacatagtaggcattcagtaaatacttacatgcatgaatgaataatgtattttcagtgtaacaaatttattataaaagtgtagttcgactcttcttggtcttggagtttgagagtacagaattacagggaatgaagagaggtataagtagatattttaatggaaatgaagtataaattaataacttgacttacccctccataagttactgctaactggagatacccttgtatgcccaacctgtaaaggaaaaagttctatttctatatttataggacattcttctcagtcaaggaacagtaagaaatatgtaggtttcaatcagttgctctcaaccctgactgcattttagaatcatttggagagtttttaaaaatatccatgcctgaatcttgattcccattttcatgtaatttgagacaagacctggtcatcagtattttttttaaagttctccaggtaatttgaatgtgcaggaaggattcagaatcactggtttaatttgttattgaaaacagtaccagtattaaatgtgtttcctcttccttcttttctgtatgtatgtgtggtttttgattttttgttgttgttgttgttttgtggccaccctttgcactagaccatcccttttattggtggtattggcctatattcccattgacaaatgcaatttttaattatttatttaatataggagtattttactgtttaatatttaaacaatgtttaatgtatttcattattaactagtattatagtttgtttttttcccatgtctccataacttttactaacatttgtttttagcagcacaacagtaatccatataaaaacaactaattcataatgaggaaaatctcataatttttaaggcagaaagaagtattaatttttgatctgccatgtagaatgagacaaatacagtttgcttatgaaaggaaagtggcatacttttaaattggtctacacagaaaagtaaaagtaaactattcatttaaataagattcattatctaataaatattgagggaatatttttcctaaataaaaatttttctgactgctaacaaaaa

SEQ ID NO: 116213 - DNA, 4683 bp, Homo sapiens
  Payload ID: 2669
  Gene Symbol: CCAR1
  Gene Name: cell division cycle and apoptosis regulator 1
  Uniprot ID: Q8IX12
  ENST ID: ENST00000265872
  CDS Start-End: 120-3572
gaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaattaa

SEQ ID NO: 116214 - DNA, 3415 bp, Homo sapiens
  Payload ID: 2669
  Gene Symbol: CCAR1
  Gene Name: cell division cycle and apoptosis regulator 1
  ENST ID: ENST00000540210
  CDS Start-End: 85-1791
cttcgatgttagccgggacccgactcaggtgaagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttg

SEQ ID NO: 116215 - DNA, 2407 bp, Homo sapiens
  Payload ID: 2669
  Gene Symbol: CCAR1
  Gene Name: cell division cycle and apoptosis regulator 1
  ENST ID: ENST00000543225
  CDS Start-End: 92-2407
gggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggac

SEQ ID NO: 116216 - DNA, 552 bp, Homo sapiens
  Payload ID: 2669
  Gene Symbol: CCAR1
  Gene Name: cell division cycle and apoptosis regulator 1
  ENST ID: ENST00000536391
  CDS Start-End: 196-552
cttcagagcaagcgcaagacatatagccccgctcattgttaagcgaggccaaggcaacccttaggcgcgctctatttcccctttcgtagcgaaagggccaggcgtattgagcggtcaggggagcgcgcacgcagaacgtcagccaatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctg

SEQ ID NO: 116217 - DNA, 869 bp, Homo sapiens
  Payload ID: 2669
  Gene Symbol: CCAR1
  Gene Name: cell division cycle and apoptosis regulator 1
  ENST ID: ENST00000543706
  CDS Start-End: 1-869
gtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctag

SEQ ID NO: 116218 - DNA, 2432 bp, Homo sapiens
  Payload ID: 2669
  Gene Symbol: CCAR1
  Gene Name: cell division cycle and apoptosis regulator 1
  ENST ID: ENST00000541012
  CDS Start-End: 107-1813
gcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaa

SEQ ID NO: 116219 - DNA, 3224 bp, Homo sapiens
  Payload ID: 2669
  Gene Symbol: CCAR1
  Gene Name: cell division cycle and apoptosis regulator 1
  ENST ID: ENST00000539539
  CDS Start-End: 95-3224
gacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactag

SEQ ID NO: 116220 - DNA, 2475 bp, Homo sapiens
  Payload ID: 2669
  Gene Symbol: CCAR1
  Gene Name: cell division cycle and apoptosis regulator 1
  ENST ID: ENST00000543229
  CDS Start-End: 95-349
gacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagat

SEQ ID NO: 116221 - DNA, 2447 bp, Homo sapiens
  Payload ID: 2669
  Gene Symbol: CCAR1
  Gene Name: cell division cycle and apoptosis regulator 1
  ENST ID: ENST00000536012
  CDS Start-End: 509-2447
gggtttgaaatggcttcgatgttagccgggacccgactcagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagata

SEQ ID NO: 116222 - DNA, 478 bp, Homo sapiens
  Payload ID: 2669
  Gene Symbol: CCAR1
  Gene Name: cell division cycle and apoptosis regulator 1
  ENST ID: ENST00000479143
  CDS Start-End: 1-146
agactgctattcgttgttgtaaggctctgacaggcattgatctaagtgtgtgcacacaatggcacaggaacacaggcacaaatgcacaccacacactacataataaacacacatggaggaacataactggtaacagcgactggtaatccagctttcagcagtatagttgatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagc

SEQ ID NO: 116223 - DNA, 754 bp, Homo sapiens
  Payload ID: 2669
  Gene Symbol: CCAR1
  Gene Name: cell division cycle and apoptosis regulator 1
  ENST ID: ENST00000538031
  CDS Start-End: 242-754
agttggcgcatgcgcctaaagctgacgggtttgaaatggcttcgatgttagccgggacccgactcaggtgaaggtctggtccccgtagttggagcagtgggcggccaagccgggtctcttaacatcttgtcgaatctgtggaagggccgggagcgatcttttgggtagcccggcggccccgggcggcgacgatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcag

SEQ ID NO: 116224 - DNA, 570 bp, Homo sapiens
  Payload ID: 2669
  Gene Symbol: CCAR1
  Gene Name: cell division cycle and apoptosis regulator 1
  ENST ID: ENST00000494903
  CDS Start-End: 286-570
tggcttcgatgttagccgggacccgactcaggtgaaggtctggtccccgtagttggagcagtgggcggccaagccgggtctcttaacatcttgtcgaatctgtggaagggccgggagcgatcttttgggtagcccggcggccccgggcggcgacggtggggctcttgtgggactgggacgggagggacgcggtcccttttgtgcgggtcggagcaggcccggcgcggccagccccacccccaccgctcggctcctcaggtgcccccagcgcccctcagcctcggcatggcgacgctgcagtccgccgccccattgctcccgagccgctgcggttttaccctcctggccccccggcccgggacatcgtggcggctcccggcggcgtgggtcttggggaatagaggctttctccatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttgga

SEQ ID NO: 116225 - DNA, 3521 bp, Homo sapiens
  Payload ID: 2669
  Gene Symbol: CCAR1
  Gene Name: cell division cycle and apoptosis regulator 1
  Uniprot ID: Q8IX12
  ENST ID: ENST00000543719
  CDS Start-End: 114-3521
tgcgcctaaagctgacgggtttgaaatggcttcgatgttagccgggacccgactcaggtgaagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatga

SEQ ID NO: 116226 - DNA, 4540 bp, Homo sapiens
  Payload ID: 2669
  Gene Symbol: CCAR1
  Gene Name: cell division cycle and apoptosis regulator 1
  ENST ID: ENST00000630771
  CDS Start-End: 190-1896
agaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 116227 - DNA, 3731 bp, Homo sapiens
  Payload ID: 2670
  Gene Symbol: CDCA2
  Gene Name: cell division cycle associated 2
  Uniprot ID: Q69YH5
  ENST ID: ENST00000330560
  CDS Start-End: 478-3549
agtccccgaggtcacaaggcagtggcaggtgtctgtagtcctcgggttgactgcagctcgcggtggtccctctccgagcccaggaagccactccagtgccgagggagaggcctgggagcgctcggagtgtgcgcggactggagaagggggaggtggcggagtgattcgtagagtaaattcggtaccgaggggcggggtcggggatttgaatcggtcggcgggcggaggaggcgggtggaggaggctgccgggcagagcgcaggccaggatcagcgcaggctgtgagtccaggtcagccgtcgggacctcgggctccgggttcgaagagcggctcccggctgcgggtgctttgccaggagagcccttccggacagaggagccggggtctggaaggagcggccgacgcgacgctcgcctgccacggggctctgggagtaagcctgtctgcctggcgggccttcaggtgcggcgtgagagatggatgccaattcaaaagacaagccccctgaaaccaaggagtctgcaatgaataatgctggaaatgcctctttcattttgggaactgggaagattgtgactcctcagaagcatgccgaattacctcctaatccttgcacaccagatacttttaaatcacctttgaacttttccacagtaaccgtagagcaattgggaattacacctgaaagctttgttaggaactctgcaggaaagtcatcatcctaccttaaaaaatgtagacgacgttctgcagtcggtgctcggggctctcctgaaacaaaccatctgattcgtttcattgctcggcagcaaaatataaagaatgctaggaaatctcctttggcacaagattctccttcccagggcagccctgcactgtatcgaaatgttaacactttaagagaacgaatatcagccttccagtcagcttttcactccataaaggaaaacgagaaaatgaccggctgtctggaattctcagaggcaggaaaagagtccgagatgacagacttgaccagaaaggaaggtctcagcgcttgccagcagtctgggttccctgcagtgttgtcctccaaacgtcggagaatatcctatcagagagactctgatgaaaatctgacggatgctgaaggaaaagtaattggtctccagatattcaatattgatacagacagagcatgtgcagttgaaacttctgtagatctttctgagatatcatctaaacttggttcaacacagtctggatttttagttgaagagtctcttcccctttcagagctcacagagacttcaaatgcactaaaggttgctgactgtgtagtgggcaaaggatcaagtgatgccgtttcgcctgacacgttcacagcagaagtgagctcagacgcagtccctgatgtcaggtcaccagctactccagcctgcaggagggaccttcccacccccaagacctttgtacttcgttctgtactgaagaaaccctctgttaagatgtgtctagagagcttacaggaacactgtaacaacctctatgatgatgatgggactcatccgagcttaatctcaaatctcccaaactgttgcaaagagaaagaagcagaagatgaagaaaattttgaagcacctgcctttctaaatatgaggaagaggaagagagttacttttggagaggacttaagcccggaagtgtttgatgaatctttgccagcaaatactccattgcgtaaaggaggaacacctgtttgtaaaaaagacttcagtggtctcagttccctgctgcttgagcagtcacctgttcctgagccattacctcaaccagattttgatgacaagggggagaatcttgaaaacatagaaccacttcaagtatcatttgccgttctcagttctcctaataaatcatcaatctctgagaccctttcaggcactgatacctttagttcttcaaataaccatgagaaaatatcctctcctaaagttggtagaataacaaggacttctaacagaagaaatcaattggtcagtgttgtagaagagagtgtttgcaacttattgaatacagaagttcagccttgtaaagaaaagaaaattaataggaggaagtctcaagaaacaaagtgtacaaagagagcacttcctaagaagagtcaggttttaaaaagttgcagaaagaagaaaggaaagggaaagaaaagtgttcagaaatctttatatggggaaagagacattgcttctaagaagcccctcctcagtcctattcccgagctgcctgaagtccctgagatgacaccttccattccgagcatccgaagactgggttcaggttatttcagttcaaatggcaaactggaagaagtgaagactcctaaaaatccagtgaaaagaaaggatcttttgcgtcatgacccagatttgcatatgcatcaaggctatgataaatatgatgtctctgaattctgctcttatataaaaagttcctcatcgcttggcaatgctacttctgatgaagatccaaatacaaatataatgaacattaatgaaaataaaaatattccaaaagcaaaaaataagtcagaaagtgaaaatgaaccaaaagctggaactgacagtcctgtttcttgtgcttctgtaactgaagaacgtgtggcatcagatagtcccaaacctgctctgaccctgcagcagggtcaagaattttctgctggtggtcaaaatgcagaaaacctttgtcagttctttaaaatttcaccagatttaaacataaagtgtgaaagaaaggatgacttcttaggagctgcagaaggaaaactgcaatgcaatcgtttaatgcctaattcacaaaaagactgtcattgtttaggagatgtcttaattgaaaatacgaaagaatctaaaagccagagtgaggatttgggaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtaagaggaggaagagcttttgtatatctacacttgcaaatactaaagccacttcccagttcaaaggctaccggagaagatcctctcttaatgggaagggagagagctctctgactgccttggaaaggattgaacataatggagaaagaaagcagtaattgacatttcctgcagagtctgtggcaagagggaaagtaaccatctatgctgaaatgatctgtctagttcccattctctgttcaacctcagtgtttcaaaagttcctaataaataaactcatttgagttgaacctacttttatgtagaaataaataagtttcttcatcattcagatagaaaa

SEQ ID NO: 116228 - DNA, 3565 bp, Homo sapiens
  Payload ID: 2670
  Gene Symbol: CDCA2
  Gene Name: cell division cycle associated 2
  ENST ID: ENST00000380665
  CDS Start-End: 404-3430
gatttgaatcggtcggcgggcggaggaggcgggtggaggaggctgccgggcagagcgcaggccaggatcagcgcaggctgtgagtccaggtcagccgtcgggacctcgggctccgggttcgaagagcggctcccggctgcgggtgctttgccaggagagcccttccggacagaggagccggggtctggaaggagcggccgacgcgacgctcgcctgccacggggctctgggagtaagcctgtctgcctggcgggccttcaggtgcggcgtgagagatggatgccaattcaaaagacaagccccctgaaaccaaggagtctgcaatgaataatgctggtatgtgatgatctgcctccttgtgaagttgaaggtttagacagagagttgtcctcacccctacaatatgtcgtccgtttcaggaaatgcctctttcattttgggaactgggaagattgtgactcctcagaagcatgccgaattacctcctaatccttgcacaccagatacttttaaatcacctttgaacttttccacagtaaccgtagagcaattgggaattacacctgaaagctttgttaggaactctgcaggaaagtcatcatcctaccttaaaaaatgtagacgacgttctgcagtcggtgctcggggctctcctgaaacaaaccatctgattcgtttcattgctcggcagcaaaatataaagaatgctaggaaatctcctttggcacaagattctccttcccagggcagccctgcactgtatcgaaatgttaacactttaagagaacgaatatcagccttccagtcagcttttcactccataaaggaaaacgagaaaatgaccggctgtctggaattctcagaggcaggaaaagagtccgagatgacagacttgaccagaaaggaaggtctcagcgcttgccagcagtctgggttccctgcagtgttgtcctccaaacgtcggagaatatcctatcagagagactctgatgaaaatctgacggatgctgaaggaaaagtaattggtctccagatattcaatattgatacagacagagcatgtgcagttgaaacttctgtagatctttctgagatatcatctaaacttggttcaacacagtctggatttttagttgaagagtctcttcccctttcagagctcacagagacttcaaatgcactaaaggttgctgactgtgtagtgggcaaaggatcaagtgatgccgtttcgcctgacacgttcacagcagaagtgagctcagacgcagtccctgatgtcaggtcaccagctactccagcctgcaggagggaccttcccacccccaagacctttgtacttcgttctgtactgaagaaaccctctgttaagatgtgtctagagagcttacaggaacactgtaacaacctctatgatgatgatgggactcatccgagcttaatctcaaatctcccaaactgttgcaaagagaaagaagcagaagatgaagaaaattttgaagcacctgcctttctaaatatgaggaagaggaagagagttacttttggagaggacttaagcccggaagtgtttgatgaatctttgccagcaaatactccattgcgtaaaggaggaacacctgtttgtaaaaaagacttcagtggtctcagttccctgctgcttgagcagtcacctgttcctgagccattacctcaaccagattttgatgacaagggggagaatcttgaaaacatagaaccacttcaagtatcatttgccgttctcagttctcctaataaatcatcaatctctgagaccctttcaggcactgatacctttagttcttcaaataaccatgagaaaatatcctctcctaaagttggtagaataacaaggacttctaacagaagaaatcaattggtcagtgttgtagaagagagtgtttgcaacttattgaatacagaagttcagccttgtaaagaaaagaaaattaataggaggaagtctcaagaaacaaagtgtacaaagagagcacttcctaagaagagtcaggttttaaaaagttgcagaaagaagaaaggaaagggaaagaaaagtgttcagaaatctttatatggggaaagagacattgcttctaagaagcccctcctcagtcctattcccgagctgcctgaagtccctgagatgacaccttccattccgagcatccgaagactgggttcaggttatttcagttcaaatggcaaactggaagaagtgaagactcctaaaaatccagtgaaaagaaaggatcttttgcgtcatgacccagatttgcatatgcatcaaggctatgataaatatgatgtctctgaattctgctcttatataaaaagttcctcatcgcttggcaatgctacttctgatgaagatccaaatacaaatataatgaacattaatgaaaataaaaatattccaaaagcaaaaaataagtcagaaagtgaaaatgaaccaaaagctggaactgacagtcctgtttcttgtgcttctgtaactgaagaacgtgtggcatcagatagtcccaaacctgctctgaccctgcagcagggtcaagaattttctgctggtggtcaaaatgcagaaaacctttgtcagttctttaaaatttcaccagatttaaacataaagtgtgaaagaaaggatgacttcttaggagctgcagaaggaaaactgcaatgcaatcgtttaatgcctaattcacaaaaagactgtcattgtttaggagatgtcttaattgaaaatacgaaagaatctaaaagccagagtgaggatttgggaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtaagaggaggaagagcttttgtatatctacacttgcaaatactaaagccacttcccagttcaaaggctaccggagaagatcctctcttaatgggaagggagagagctctctgactgccttggaaaggattgaacataatggagaaagaaagcagtaattgacatttcctgcagagtctgtggcaagagggaaagtaaccatctatgctgaaatgatctgtctagttcccattctctgttcaacctcagtgtttcaaaagttcctaataaataaactcatttgagttgaacct

SEQ ID NO: 116229 - DNA, 1047 bp, Homo sapiens
  Payload ID: 2671
  Gene Symbol: CDCA3
  Gene Name: cell division cycle associated 3
  ENST ID: ENST00000229265
  CDS Start-End: 89-820
gttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaacctt

SEQ ID NO: 116230 - DNA, 2760 bp, Homo sapiens
  Payload ID: 2671
  Gene Symbol: CDCA3
  Gene Name: cell division cycle associated 3
  ENST ID: ENST00000422785
  CDS Start-End: 106-765
gagttgagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcagcctcctcagttccagattttgaggaagctgtcccaggaacctgtggccacagccatcccgtcagctgtgactcccaggcagctcaccctgttatcgtggccagagaggatgcctgaggaagagggaaaggagtcagcctgtctctccaagctgatttggaaagcagtgtgtgcatgcgtgtaagtgtatgtgtgggtgtgtgggtgtgtgtgtgtatgtgggtgtgtggggggatatgtgtgcatgtgtatgcatgtgtgggtgtgtgtacgtgtgtgtgtgcatgtgtgcttgagcacatgcatgcagggatcctagactcggtagactgggctcaacccctgaagaaggctaagagactgaaagaggattagctgtagggcagggggttctctgtcaagagctttggttgggggagggctgggatcagacagagaaaggctggaagcatctgtgtactatgaaaaaacccgagggcaccttgacaggtgctggaaaagagaaggcaaccgttcatcctatttctttgcttccagatgaagaaactgaggcccatggaggagtgacttgtgcaaggacactcagaaagtgagcaacagaattaggatttggattctgcccctggccagtgttattttcatcagcacctggcctcttgatagagaagaagccatcctatctgaccaacttcaggctagtcttagatgagccctaggctgcagtcagggccctcgggccactccagatctccttgattctgccttgattccatgtttccctgaggctgtcttgcctctcagtgggtgcccctgaaatgccaggaacccagaactgactggacagtcatggtccacagatctcctagggcagggagcagtcatggcattgggcagtggagagaggctgcttagagcaacactgagggaaaacagtcctagttgggaaccaaggggtactggattccaggggtggagtcacccagtgacaagggacagcagtaagagagtccgaaatgggagctgatggggggtacagaatggggagggagggctggggagggtccttccagctgaggaagcagcagccagggctggcccttacccacacgctcagacttcatggagtcccagacattgcagttgaagtcgtcgtagccagcgaatagtaggcggccactgagggagaaggccacggacgtgatgccgcagatgatgctctcgtgggagaagcagatcagctcctggtctgcccgcaggtcaaacaagcggcaggaagcgtcatccgagcccgtgcagatggcctctccattggggaagaactgagggcacgggtggcaagtgggtcagggatcagacctgggcagcccacagcctctcccgccctctgcctcccacctgacagctccagggcaagccgctgctctcagcctccctgcctgtccctcccttggtttggggtgagaagcagccctgccaacacataccacgtgccagtgacttccctatgcccctcgcccgctctgcactatacagcgctgcaggcaggcatcatttccacgtcgcaggcaagagcaccaaggcttgcctgcagtgacccggctagaagggcggacggaggttgtcccagactcccagactacacaagtgggctggatcagggtgtgtaagaacagggtccagtacaaatgcaaggcctggatctcacggcgagcaaatgtcagataagctcaaacggagggagagtctacagaaaactggtttgtactcttcaaaaacgtcaatgacataaaagacaaaggtgggaaaacagttccagtttaaaggtggtgacgaaaaagatatggcgaggaaaggtaatgcacgtttctggattggatcctggacagaaaaaaacatgagctattatggacatttttgaggctattggtgaaatttgaatatagactgtagactgtagtattgtgtcaatgttgagtttcctgatcttaagaatcatacagtgattatgctacagaagggctttgtttcgggaagtacttaaggggtaaagaaacatgatgtctgcaacctactttcaaaagacacagaaagaaaatgtatatctacatctaa

SEQ ID NO: 116231 - DNA, 985 bp, Homo sapiens
  Payload ID: 2671
  Gene Symbol: CDCA3
  Gene Name: cell division cycle associated 3
  ENST ID: ENST00000540683
  CDS Start-End: 86-634
gtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgt

SEQ ID NO: 116232 - DNA, 1943 bp, Homo sapiens
  Payload ID: 2671
  Gene Symbol: CDCA3
  Gene Name: cell division cycle associated 3
  Uniprot ID: Q99618
  ENST ID: ENST00000538862
  CDS Start-End: 903-1709
gcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaaactggtaacttcgggagttgagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccga

SEQ ID NO: 116233 - DNA, 1327 bp, Homo sapiens
  Payload ID: 2671
  Gene Symbol: CDCA3
  Gene Name: cell division cycle associated 3
  Uniprot ID: Q99618
  ENST ID: ENST00000535406
  CDS Start-End: 307-1113
cgagctgttgtgcatccagaggtggaattggggcccggtaagtgatttgaataatttaataaataagttagagggctcagcaggcccagaacgagccattttgtcagctgcagcagtcattaactccgcagaggcctctggtccctcgccaggaagtttcttcactggaaactgggaagacagggtggtttagggttgaaggtccgacgtggaagagataagggctgagacctgagtcacttctcacaggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggt

SEQ ID NO: 116234 - DNA, 2513 bp, Homo sapiens
  Payload ID: 2672
  Gene Symbol: CDCA4
  Gene Name: cell division cycle associated 4
  Uniprot ID: Q9BXL8
  ENST ID: ENST00000336219
  CDS Start-End: 157-882
agcgcagcgtcgaccctttgtggacgccgagtggcggtcgctcgccccgccccgcgccgtcgggcgctccttcctcagcggcgggaagctggcggcagcggcggtggcggtggctgagcagaggacccggcgggcggcctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaacctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagcgccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggagccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccatcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaatgggaatgtggtgttagttacgaccacggcctgaccctccagcaacctttctgcaggatcagttctgctgtattatctggtggtgctttctaaggtggggaaaggaattgcacttggctgcattaaatggacgctgggttacttttatttcccccccccacagggttgcagagcaaattctttttacattgttcagcgcccggctggagttgggggtgtccacgacctctgacagcccccgatgtcgaaagttaatcctcatggaccctagtttaaagggtatgtgttttataggaataaatctaaagcactattttgtttctgtatagcatttttatcttttagaaacatcatttgttcagc

SEQ ID NO: 116235 - DNA, 1536 bp, Homo sapiens
  Payload ID: 2672
  Gene Symbol: CDCA4
  Gene Name: cell division cycle associated 4
  Uniprot ID: Q9BXL8
  ENST ID: ENST00000392590
  CDS Start-End: 69-794
ctggcggcagcggcggtggcggtggctgagcagaggacccggcgggcggcctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaacctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacactgagcatcactacagtctcagtcaacagtgtgaatgtatcatgttttactttaaatgtgtgtgtgatacttcttcattatgtcctgcgctgcagtgagacctgggtgaaaatcaggagccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccatcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaa

SEQ ID NO: 116236 - DNA, 2587 bp, Homo sapiens
  Payload ID: 2673
  Gene Symbol: CDCA5
  Gene Name: cell division cycle associated 5
  Uniprot ID: Q96FF9
  ENST ID: ENST00000275517
  CDS Start-End: 174-932
gacgggtggaaaagactcggggttccgagggccgcagaccgctagccctacgtcacttccgcttcctttcccgcagggcgggtaattcgaacgttttttgcagcgagtggccttcccggttggcgcgcgcccggggcggcggcgctggaggagctcgagacggagcctaagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccaggggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgttcat

SEQ ID NO: 116237 - DNA, 1012 bp, Homo sapiens
  Payload ID: 2673
  Gene Symbol: CDCA5
  Gene Name: cell division cycle associated 5
  ENST ID: ENST00000404147
  CDS Start-End: 70-993
gagtggccttcccggttggcgcgcgcccggggcggcggcgctggaggagctcgagacggagcctaagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttggtgagtgagaggcaggggtttttctctgccgtgtgctctgggagacgtgcagggctggggctctggctcttttgggggataggcagcacctgcagggtgtgggtgagatgctccagccaccatgttcccttctcactcacctgctcctcatttctcttccctcagaaaacggagctggatgagtgggctgcggccatgaatgccgagtttgaagctgctgagcagtttgatctcctggttgaatgagatgcagtggggggtgcac

SEQ ID NO: 116238 - DNA, 835 bp, Homo sapiens
  Payload ID: 2673
  Gene Symbol: CDCA5
  Gene Name: cell division cycle associated 5
  ENST ID: ENST00000524733
  CDS Start-End: 1-212
tcagaaagcccatcgtcttaaagaggatcgtggcccatgctgtagaggtcccagctgtccaatcacctcgcaggagccctagggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccaggggctctgccagcctcggcctctccctcctgagttgccttctgttggtggctttcttcttgaacccacctgtgtaaag

SEQ ID NO: 116239 - DNA, 789 bp, Homo sapiens
  Payload ID: 2673
  Gene Symbol: CDCA5
  Gene Name: cell division cycle associated 5
  ENST ID: ENST00000529290
  CDS Start-End: 1-763
acagaaacgtaagaagaagaaaatgccagagatcttgtctcttaggggcagacaaagagcccactccaagctggccaacaagccagtggtgcagcctgttgaggagcaagaacccaagggccctcaggcttccgaggagcggaacttggagccaccttcctcagaacaactggaacccaccgtcacgttcctgtttacactcctgaacacctctgagcccactgagccaaaagaccctgaatcggactcggagatccaggagtaccagttcttagatcaggaggactggggcccccagcggacctcaaaggagatcaggcagttgcagaatgactgcatgaggcttcgggagtcactgaacaccacccaagtgcacaacctggccctgggggagaagctgcagaacctgcccaccttattgtataagagcctgaaggagggagcccaggccatccaggaggaggcccaggccatccaggatgaagtgaaggccctgcaggaggaaagccaggccctgccggaggtggctctgctcaggtgtgcgggcagccatggcagcggggagggaagaggcggctgccccatgctgctcactcgagctgtctctgcctgcagtgacccaaacccccggaaggcaggtctcctcttcaagctgcctgacctgccccacgaccacagagaccagggtcaggcctggccaggccccaggccagaggtcggacacctcctcgggaggccgctccttcagccagctcctccctagatcccagaaataaacttggaagctaa

SEQ ID NO: 116240 - DNA, 672 bp, Homo sapiens
  Payload ID: 2673
  Gene Symbol: CDCA5
  Gene Name: cell division cycle associated 5
  ENST ID: ENST00000525464
  CDS Start-End: 1-672
cctggaatctccccaccacccgagaaacagaaacgtaagaagaagaaaatgccagagatcttgtctcttaggggcagacaaagagcccactccaagctggccaacaagccagtggtgcagcctgttgaggagcaagaacccaagggccctcaggcttccgaggagcggaacttggagccaccttcctcagaacaactggaacccaccgtcacgttcctgtttacactcctgaacacctctgagcccactgagccaaaagaccctgaatcggactcggagatccaggagtaccagttcttagatcaggaggactggggcccccagcggacctcaaaggagatcaggcagttgcagaatgactgcatgaggcttcgggagtcactgaacaccacccaagtgcacaacctggccctgggggagaagctgcagaacctgcccaccttattgtataagagcctgaaggagggagcccaggccatccaggaggaggcccaggccatccaggatgaagtgaaggccctgcaggaggaaagccaggccctgccggaggtggctctgctcagtgacccaaacccccggaaggcaggtctcctcttcaagctgcctgacctgccccacgaccacagagaccagggtcaggcctggccaggccccaggccagaggtcggacac

SEQ ID NO: 116241 - DNA, 692 bp, Homo sapiens
  Payload ID: 2673
  Gene Symbol: CDCA5
  Gene Name: cell division cycle associated 5
  ENST ID: ENST00000527430
  CDS Start-End: 1-173
tgtctgggaggcgaacgcggtccggaggagccgctcagcgctccgggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtggg

SEQ ID NO: 116242 - DNA, 2500 bp, Homo sapiens
  Payload ID: 2674
  Gene Symbol: CDCA7
  Gene Name: cell division cycle associated 7
  Uniprot ID: Q9BWT1
  ENST ID: ENST00000347703
  CDS Start-End: 145-1260
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcacagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaa

SEQ ID NO: 116243 - DNA, 2789 bp, Homo sapiens
  Payload ID: 2674
  Gene Symbol: CDCA7
  Gene Name: cell division cycle associated 7
  Uniprot ID: Q9BWT1
  ENST ID: ENST00000306721
  CDS Start-End: 104-1456
ctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaaacctaaattcaggtcagatatcagtgaagaactggcaaatgttttttatgaggactctgataatgaatctttctgcggcttttcagaaagtgaggtgcaagatgtattagaccattgtggatttttacagaaaccaaggccagatgtcactaacgaactggccggtatttttcatgccgactctgacgatgaatcattttgcggtttctcagagagtgagatacaagatggaatgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcacagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttctaaaaaa

SEQ ID NO: 116244 - DNA, 1369 bp, Homo sapiens
  Payload ID: 2674
  Gene Symbol: CDCA7
  Gene Name: cell division cycle associated 7
  Uniprot ID: Q9BWT1
  ENST ID: ENST00000410101
  CDS Start-End: 93-1313
gctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaaaccaaggccagatgtcactaacgaactggccggtatttttcatgccgactctgacgatgaatcattttgcggtttctcagagagtgagatacaagatggaatgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagttt

SEQ ID NO: 116245 - DNA, 1488 bp, Homo sapiens
  Payload ID: 2674
  Gene Symbol: CDCA7
  Gene Name: cell division cycle associated 7
  Uniprot ID: Q9BWT1
  ENST ID: ENST00000410019
  CDS Start-End: 93-1082
gctgctgctgctcctcctgctgtgggaccgctgaccgcgcggctgctccgctctccccgctccaagcgccgatctgggcacccgccaccagcatggacgctcgccgcgtgccgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcacagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcaga

SEQ ID NO: 116246 - DNA, 928 bp, Homo sapiens
  Payload ID: 2674
  Gene Symbol: CDCA7
  Gene Name: cell division cycle associated 7
  ENST ID: ENST00000435616
  CDS Start-End: 77-247
ctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaaagtgaggtgcaagatgtattagaccattgtggatttttacagaaaccaaggccagatgtcactaacgaactggccggtatttttcatgccgactctgacgatgaatcattttgcggtttctcagagagtgagatacaagatggaatgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcaacaaacgaaggggacctagaggaaaccccctgacagatctctggatgatcctccttgaatcctgggcagtttggtctctccttgctgtgctcctgtggcactaaactccttttgattggttctttctttccttcccagctagactaagcccctcatgggcagcaatcaaggagaccgcgaaggcgtacattcccgggtgttgcttccaggagaaaccctgaacggagagctcgtcctctta

SEQ ID NO: 116247 - DNA, 2915 bp, Homo sapiens
  Payload ID: 2675
  Gene Symbol: CDCA7L
  Gene Name: cell division cycle associated 7-like
  Uniprot ID: Q96GN5
  ENST ID: ENST00000356195
  CDS Start-End: 231-1493
ggtgcgccgggccgtggtgagtccgggctcccgtggccgcgtgctgggaggagactggagcccggttaggaagaatggagttggcgactcgctaccagagcacttcgcaggcatagtttggaagtcatcagggctggttcttttccttccagatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagaaagatttttttacagttgtgtttttatacagaaattctttgtagaaattactattttttgttaaagattgtttatatgcttacaaagatttctcaggaagacagcagagcagaggaatctatatagatgtatgcacagacctgtctgtatgctgaactttgttaaaaatatctgccagttattaaaaagcacagtttaaatggggtggggttaaagttcaggtaagtaagttagagagaaaacattgtatgatcagctcctgcacttgatctatctatctttggcttcccaaacagtaactcactccaggccaagtgtgccttagcacgagtgaccacagtttaatagaccacacacatcgtttaacctgctcttggtcattggaaatttacactgaacaaagtgcaattaactgtagaacagttttatttttattaaaacttgactgaacaaaaggggaccatcaacattgtagacactggacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagttagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagtaagttgtttgatgcaataaacattcaacattctggttttgtcat

SEQ ID NO: 116248 - DNA, 1830 bp, Homo sapiens
  Payload ID: 2675
  Gene Symbol: CDCA7L
  Gene Name: cell division cycle associated 7-like
  Uniprot ID: Q96GN5
  ENST ID: ENST00000373934
  CDS Start-End: 81-1307
gttcttggtgcgccgggccgtggtgagtccgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacaggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagaaagatttttttacagttgtgtttttatacagaaattctttgtagaaattactattttttgttaaagattgtttatatgcttacaaagatttctcaggaagacagcagagcagaggaatctatatagatgtatgcacagacctgtctgtatgctgaactttgttaaaaatatctgccagttattaaaaagcacagtttaaatggggtggggttaaagttcaggtaagtaagttagagagaaaacattgtatgatcagctcctgcacttgatctatctatctttggcttcccaaacagtaactcactccaggccaagtgtgccttagcacgagtgaccacagtttaatagaccacacacatcgtttaacctgctcttggtcattggaaatttacactgaacaaagtgcaattaactgtagaacagttttatttttattaaaacttgactga

SEQ ID NO: 116249 - DNA, 3066 bp, Homo sapiens
  Payload ID: 2675
  Gene Symbol: CDCA7L
  Gene Name: cell division cycle associated 7-like
  Uniprot ID: Q96GN5
  ENST ID: ENST00000406877
  CDS Start-End: 281-1645
aactgcagccccctctcgcgccgcctgcgaagacaaggtcagtggccgcgaagttggaacgtgatcggagccacgaggcccagtgaggcggcaccgagggggcagcgcaacgcgctccccctgtccagggcgtcaagtgcgcccctcccggggcccgcctgtgctccgggcggagcgcgctagctgctcgggcgcggggcgttcttggtgcgccgggccgtggtgagtccgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagaaagatttttttacagttgtgtttttatacagaaattctttgtagaaattactattttttgttaaagattgtttatatgcttacaaagatttctcaggaagacagcagagcagaggaatctatatagatgtatgcacagacctgtctgtatgctgaactttgttaaaaatatctgccagttattaaaaagcacagtttaaatggggtggggttaaagttcaggtaagtaagttagagagaaaacattgtatgatcagctcctgcacttgatctatctatctttggcttcccaaacagtaactcactccaggccaagtgtgccttagcacgagtgaccacagtttaatagaccacacacatcgtttaacctgctcttggtcattggaaatttacactgaacaaagtgcaattaactgtagaacagttttatttttattaaaacttgactgaacaaaaggggaccatcaacattgtagacactggacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagttagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagtaagttgtttgatgcaataaacattcaacattctggttttgtca

SEQ ID NO: 116250 - DNA, 611 bp, Homo sapiens
  Payload ID: 2675
  Gene Symbol: CDCA7L
  Gene Name: cell division cycle associated 7-like
  ENST ID: ENST00000435717
  CDS Start-End: 1-295
ggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagaggtaagtaagtctctagcagcttacaaaacagcttgaaatcttgaggctgagcacaggagaccctctgggcaagtagttgttgccttcccgtgtgacttacttacttatataaaccacgagtaccatccattctgtatctgtttgcattggaaaagctcaggcctgatattttccctattagggaatcttctcctttgctagatttttcaactcaactccacgttgcctttaaccaaaatttctccttgaggtgtatgacagaaatggaaggaacaaacaaacaaggcaggctgaggggaaagacacagattatgaagaggcagc

SEQ ID NO: 116251 - DNA, 568 bp, Homo sapiens
  Payload ID: 2675
  Gene Symbol: CDCA7L
  Gene Name: cell division cycle associated 7-like
  ENST ID: ENST00000457951
  CDS Start-End: 100-568
agctgctcgggcgcggggcgttcttggtgcgccgggccgtggtgagtccgggctcccgtggccgcgtgctgggaggagactggagcccggttaggaagaatggagttggcgactcgctaccagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctc

SEQ ID NO: 116252 - DNA, 563 bp, Homo sapiens
  Payload ID: 2675
  Gene Symbol: CDCA7L
  Gene Name: cell division cycle associated 7-like
  ENST ID: ENST00000435031
  CDS Start-End: 276-563
acttgttttattgagagtcgcgagactcactgcttccaccttgcttccgactggtgtttactttcctccacctgcgtgcctggcccgggagaaggggaggcggggccgccagcgttggaaggcgcagagtgcccggcgcccgagcccaaaccgctgtcacctgcccgagtctggcggcaaagactgagccactaacgatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccct

SEQ ID NO: 116253 - DNA, 569 bp, Homo sapiens
  Payload ID: 2675
  Gene Symbol: CDCA7L
  Gene Name: cell division cycle associated 7-like
  ENST ID: ENST00000447180
  CDS Start-End: 231-569
ggtgcgccgggccgtggtgagtccgggctcccgtggccgcgtgctgggaggagactggagcccggttaggaagaatggagttggcgactcgctaccagagcacttcgcaggcatagtttggaagtcatcagggctggttcttttccttccagatccctaaagaagtggctgacatctttaacgcccccagtgatgatgaagagtttgttggcttccgagatgatgttcccatggaaaccctctcgtcagaggagagctgcgatagttttgactcactagagtcagggaaacaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttc

SEQ ID NO: 116254 - DNA, 2303 bp, Homo sapiens
  Payload ID: 2676
  Gene Symbol: CDCA8
  Gene Name: cell division cycle associated 8
  Uniprot ID: Q53HL2
  ENST ID: ENST00000327331
  CDS Start-End: 114-956
gtgactgtggagtttgaattgggtggcggttgactgtagagccgctctctctcactggcacagcgaggttttgctcagcccttgtctcgggaccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggtgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttttctt

SEQ ID NO: 116255 - DNA, 2469 bp, Homo sapiens
  Payload ID: 2676
  Gene Symbol: CDCA8
  Gene Name: cell division cycle associated 8
  Uniprot ID: Q53HL2
  ENST ID: ENST00000373055
  CDS Start-End: 274-1116
gggccggcaggaacttgcttgtgattggatgttgtgggacggcggcttctcattcgtcagcctgtgactgtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggtgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttttcttttgtaa

SEQ ID NO: 116256 - DNA, 1177 bp, Homo sapiens
  Payload ID: 2677
  Gene Symbol: CGREF1
  Gene Name: cell growth regulator with EF-hand domain 1
  Uniprot ID: Q99674
  ENST ID: ENST00000260595
  CDS Start-End: 77-982
gggcggcgcagcagccaggagcgcccacggagctggacccccagagccgcgcggcgccgcagcagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatcttgatagtggacaaagtgctcgagacccaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgcctggtcccagtaggtatcaggtctttctgtgcagctcagggagaccctaagttaaggggcagattaccaataaagaactgaatgaattc

SEQ ID NO: 116257 - DNA, 1610 bp, Homo sapiens
  Payload ID: 2677
  Gene Symbol: CGREF1
  Gene Name: cell growth regulator with EF-hand domain 1
  Uniprot ID: Q99674
  ENST ID: ENST00000312734
  CDS Start-End: 493-1449
gcggcggctggcactggctccggactctgcccggccagggcggcggctccagccgggagggcgacgtggagcggccacgtggagcggcccgggggaggctggcggcgggaggcgaggcgcgggcggcgcagcagccaggagcgcccacggagctggacccccagagccgcgcggcgccgcagcagctttactcctgaagccagcgagatcacgaacccactgggagaaacgaacaactccagacgcactaccttaagagctgtaacactcactgcgaaggtccgcagctgcattcctgagccagcgagaccacaaacccaccagaaggaagaaacttcgaacgcatccgaacatcagaaggaacaaactccagacacgccgcctttaggaactgtaacactcaaccgcgagggtccgcggcttcattcttgaagtcagtgagaccaagaacccaccaattccggacacactgggattacagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatcttgatagtggacaaagtgctcgagacccaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgcctggtcccagtaggtatcaggtctttctgtgcagctcagggagaccctaagttaa

SEQ ID NO: 116258 - DNA, 1575 bp, Homo sapiens
  Payload ID: 2677
  Gene Symbol: CGREF1
  Gene Name: cell growth regulator with EF-hand domain 1
  Uniprot ID: Q99674
  ENST ID: ENST00000402550
  CDS Start-End: 282-680
ctcacacgggcgcgcgcagcccctccggccgcgggcgcagcgggggcgctggtggagctgcgaagggccaggtccggcgggcggggcggcggctggcactggctccggactctgcccggccagggcggcggctccagccgggagggcgacgtggagcggccacgtggagcggcccgggggaggctggcggcgggaggcgaggcgcgggcggcgcagcagccaggagcgcccacggagctggacccccagagccgcgcggcgccgcagcagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccgggcaacctggacgccaggctggatggaggggagaaggcgatgcagccgcaatggtagtctccatggtgtgtgaggagccggcacctgctctcacacgatgccatcaaagccctgcaggccacacttcttgccggccacctggcacccgaatctcagtgcttcctgcacgctcctccctggaggaggggcaagtagctaggtcagccaggtgtttggggcagggacaggtcccagtccttttcccctcctgctgccatactcaccctgggagaggctgaagatgacggaggcattgaaggtgtctccagctcccagtgtatccaccacgcggggtggcgggaaagcatccgagtggagcaatttgccatcagggcccagggcgtcggcgccctcctcagcccaggcacagacaagcacagccctgcaagacggctccactcagctgggtgttagcccaccccgtccccccagccatcctcccagctccagggcggactcctggagtccaggctcatcctgtaccttctaaagccccttcctggcttccccggctcaccctttcctcacacgaccatacaagcccctcaaggcttcctctgctgactggaaccccaagtgcttggccacatctttgctgacaaacacctgtgggcagtggaagagaagctggtggtcacttctaactcgtcattcaccaacagcagcctagcgttgcccccattacaacacgactcccccaacatgtccacatagatccccaacgtagcatctcactgtcccacgggaacgtggttttcttttttctttattttttgtgaagatggtctccctgaggctggtcttgaactcctggccccatatgatcttcctgcctcagcctcccaaaatttctgggattacaggtgtgagtcactgcacctggccagaagcatatttttatcgatgcttatat

SEQ ID NO: 116259 - DNA, 1906 bp, Homo sapiens
  Payload ID: 2677
  Gene Symbol: CGREF1
  Gene Name: cell growth regulator with EF-hand domain 1
  Uniprot ID: Q99674
  ENST ID: ENST00000402394
  CDS Start-End: 270-1226
cgcgcagcccctccggccgcgggcgcagcgggggcgctggtggagctgcgaagggccaggtccggcgggcggggcggcggctggcactggctccggactctgcccggccagggcggcggctccagccgggagggcgacgtggagcggccacgtggagcggcccgggggaggctggcggcgggaggcgaggcgcgggcggcgcagcagccaggagcgcccacggagctggacccccagagccgcgcggcgccgcagcagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatcttgatagtggacaaagtgctcgagacccaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgcctggtcccagtaggtatcaggtctttctgtgcagctcagggagaccctaagttaaggggcagattaccaataaagaactgaatgaattcatccccccggccacctctctacccgtccagcctgcccagaccctctcagaggaacggggttggggaccgaaaggacagggatgccgcctgcccagtgtttctgggcctcacggtgctccggcagcagagcgcatggtgctagccatggccggctgcagaggacccagtgaggaaagctcagtctatccctgggccccaaaccctcaccggttccccctcacctggtgttcagacaccccatgctctcctgcagctcagggcaggtgaccccatccccagtaatattaatcatcactagaactttttgagagccttgtacacatcaggcatcatgctgggcattttatatatgattttatcctcacaataattctgtagccaagcagaattggttccatttgacagatgaagaaattgaggcagattgcgttaagtgctgtaccctaaggtgatatgcagctaattaaatggcagattttaatcca

SEQ ID NO: 116260 - DNA, 1376 bp, Homo sapiens
  Payload ID: 2677
  Gene Symbol: CGREF1
  Gene Name: cell growth regulator with EF-hand domain 1
  Uniprot ID: Q99674
  ENST ID: ENST00000404694
  CDS Start-End: 6-1328
gtaagatgaatgggctgaaggaggtcagatatgcttgcgctgtacttctctgggcaccttggcacctagtggggagcaagggaatggggcgtggggtggggatgcgcccccagctctgcttccgccacagcaggcctgcctttatgtgctttatatacaagagctggagtgacatttattttgagcatagttccatgggatccctgctgtctgtctgtgagtcctccctgagcaggagtcctgtctttggggctgcaggtagaagcaggcagaaaatgcgcttgtgtctaacccagcccatctgtgacacggtggcagacgcctctttcccccgacccctgattctcttccttgttccagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatcttgatagtggacaaagtgctcgagacccaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataag

SEQ ID NO: 116261 - DNA, 1346 bp, Homo sapiens
  Payload ID: 2677
  Gene Symbol: CGREF1
  Gene Name: cell growth regulator with EF-hand domain 1
  Uniprot ID: Q99674
  ENST ID: ENST00000405600
  CDS Start-End: 143-1099
gcgcagcagccaggagcgcccacggagctggacccccagagccgcgcggcgccgcagcaggtgggtgacaccccgccccggccggccggagacccgagcccatcgccgtcagccagccagggccgcgcgggttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggacttctgcagagctacctaaagggactaggaaggacagaagtgcaactggagcatctgagccgggagcaggttctcctctacctctttgccctccatgactatgaccagagtggacagctggatggcctggagctgctgtccatgttgacagctgctctggcccctggagctgccaactctcctaccaccaacccggtgatcttgatagtggacaaagtgctcgagacccaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgcctggtcccagtaggtatcaggtctttctgtgcagctcagggagaccctaagttaaggggcagattaccaataaagaactgaatgaattcatccccccggccacctctctacccgtccagcctgcccagaccctctcagagg

SEQ ID NO: 116262 - DNA, 1695 bp, Homo sapiens
  Payload ID: 2677
  Gene Symbol: CGREF1
  Gene Name: cell growth regulator with EF-hand domain 1
  ENST ID: ENST00000440612
  CDS Start-End: 264-437
gcccctccggccgcgggcgcagcgggggcgctggtggagctgcgaagggccaggtccggcgggcggggcggcggctggcactggctccggactctgcccggccagggcggcggctccagccgggagggcgacgtggagcggccacgtggagcggcccgggggaggctggcggcgggaggcgaggcgcgggcggcgcagcagccaggagcgcccacggagctggacccccagagccgcgcggcgccgcagcagttccaggaaggatgttacctttgacgatgacagtgttaatcctgctgctgctccccacgggtcaggctgccccaaaggatggagtcacaaggccagactctgaagtgcagcatcagctcctgcccaaccccttccagccaggccaggagcagctcggttctcctctacctctttgccctccatgactatgaccagagtggacagctggatggcctggagctgctgtccatgttgacagctgctctggcccctggagctgccaactctcctaccaccaacccggtaagctctgctggatggagatccccgcataaaggagacccagcactttggggctttggtctttctcatcataactcttttggccttacccaccctatattggagttggccccaattccaatatgtgttccagatcggacctccctgaggacagcaacactctgtatcctgggtcacatttgtggctgaggcacgcccttaattccaagggcaacctggacgccaggctggatggaggggagaaggcgatgcagccgcaatggtagtctccatggtgtgtgaggagccggcacctgctctcacacgatgccatcaaagccctgcaggccacacttcttgccggccacctggcacccgaatctcagtgcttcctgcacgctcctccctggaggaggggcaagtagctaggtcagccaggtgtttggggcagggacaggtcccagtccttttcccctcctgctgccatactcaccctgggagaggctgaagatgacggaggcattgaaggtgtctccagctcccagtgtatccaccacgcggggtggcgggaaagcatccgagtggagcaatttgccatcagggcccagggcgtcggcgccctcctcagcccaggcacagacaagcacagccctgcaagacggctccactcagctgggtgttagcccaccccgtccccccagccatcctcccagctccagggcggactcctggagtccaggctcatcctgtaccttctaaagccccttcctggcttccccggctcaccctttcctcacacgaccatacaagcccctcaaggcttcctctgctgactggaaccccaagtgcttggccacatctttgctgacaaacacctgtgggcagtggaagagaagctggtggtcacttctaactcgtcattcaccaacagcagcctagcgttgcccccattacaacacgactcccccaacatgtccacatagatccccaacgtagcatctcactgtcccacgggaacgtggttttcttttttctttattttttgtgaagatggtctccctgaggctggtcttgaactcctggccccatatgatcttcctgcctcagcctcccaaaatttctgggattacaggtgtgagtcactgcacctggccagaagcatatttttatcgatgcttatat

SEQ ID NO: 116263 - DNA, 2057 bp, Homo sapiens
  Payload ID: 2678
  Gene Symbol: CGRRF1
  Gene Name: cell growth regulator with ring finger domain 1
  Uniprot ID: Q99675
  ENST ID: ENST00000216420
  CDS Start-End: 133-1131
aagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaactggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttgaaaagaatctaagagtttggccttttattagctagatttcctctcatgttaattagaaaaatcattctgaaaggcaatccattgaaaatttgaggaggttaaattcttaagatcactaaatgttttacctttgatgtaatcggagtgcaattaagaaaaaacttaattctacttaaagtaattgtgtgttccctagtttatacaaaggagttggaatgagcttctttagatcttttcctgaaataacagcttttataaatatccatctgtttggtttctaatgtcccttattatagttacgtaaatacaggtcatagttttaaatataggttcttaaatcataaatacaagatataattcttgactgttctccgtgtattataaaatgatactcatctataggaggcagatatataaaattcggataataagattttttggataattaaatttattaaattgatagtcaagtgtgattagattagcagaatgtgatctccagggaagatctgtgagacctttaatgccttaccttagatttctgcctgcacagcaaatccatccagaactgaggtgggaggtggaggttatagagctagaaaaatcactaaaagaaacaaataactatttttttctagtgtatttttattccaaataaaccctgtattcttctgaatagtaaattactttattcatccat

SEQ ID NO: 116264 - DNA, 668 bp, Homo sapiens
  Payload ID: 2678
  Gene Symbol: CGRRF1
  Gene Name: cell growth regulator with ring finger domain 1
  ENST ID: ENST00000557317
  CDS Start-End: 55-668
gggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaatagagacagtgtttcaccatgttgaccaggctggtctcaaactcctgacctcagatgatccacccacctcagcctcccaaagtgctgggattacagctggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccatt

SEQ ID NO: 116265 - DNA, 622 bp, Homo sapiens
  Payload ID: 2678
  Gene Symbol: CGRRF1
  Gene Name: cell growth regulator with ring finger domain 1
  ENST ID: ENST00000557755
  CDS Start-End: 49-183
ggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatgctggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccc

SEQ ID NO: 116266 - DNA, 719 bp, Homo sapiens
  Payload ID: 2678
  Gene Symbol: CGRRF1
  Gene Name: cell growth regulator with ring finger domain 1
  ENST ID: ENST00000554791
  CDS Start-End: 149-424
catgagaaccccaggcaagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaaatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtg

SEQ ID NO: 116267 - DNA, 605 bp, Homo sapiens
  Payload ID: 2678
  Gene Symbol: CGRRF1
  Gene Name: cell growth regulator with ring finger domain 1
  ENST ID: ENST00000556172
  CDS Start-End: 1-222
atttccatggtgtcagtgattcatattcctgataggacttataaactatcctgcagaatattgtatcaatatttactcttggctcaaggtcaatttcatgatcttaagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttgaaaag

SEQ ID NO: 116268 - DNA, 7226 bp, Homo sapiens
  Payload ID: 2679
  Gene Symbol: CEMIP
  Gene Name: cell migration inducing protein, hyaluronan binding
  Uniprot ID: Q8WUJ3
  ENST ID: ENST00000220244
  CDS Start-End: 289-4374
aaaagcggcctctcggctgagggccggggagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatc

SEQ ID NO: 116269 - DNA, 7297 bp, Homo sapiens
  Payload ID: 2679
  Gene Symbol: CEMIP
  Gene Name: cell migration inducing protein, hyaluronan binding
  Uniprot ID: Q8WUJ3
  ENST ID: ENST00000356249
  CDS Start-End: 360-4445
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagagaaaagcttcattctggaggggaaggagttttgagtgccaaggatgaaattccacccatcactcggtctctgagctgcaggacacaggcaggacaacgggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatc

SEQ ID NO: 116270 - DNA, 7357 bp, Homo sapiens
  Payload ID: 2679
  Gene Symbol: CEMIP
  Gene Name: cell migration inducing protein, hyaluronan binding
  Uniprot ID: Q8WUJ3
  ENST ID: ENST00000394685
  CDS Start-End: 420-4505
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagagaaaagcttcattctggaggggaaggagttttgagtgccaaggatgaaattccacccatcactcggtctctgagctgcaggacacaggcaggacaacggtaggattttcatgccccgatctgcctggccttgagttgtggcagctggggaagccactgggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatc

SEQ ID NO: 116271 - DNA, 385 bp, Homo sapiens
  Payload ID: 2679
  Gene Symbol: CEMIP
  Gene Name: cell migration inducing protein, hyaluronan binding
  ENST ID: ENST00000495041
  CDS Start-End: 1-229
catcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcaggaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcagga

SEQ ID NO: 116272 - DNA, 648 bp, Homo sapiens
  Payload ID: 2679
  Gene Symbol: CEMIP
  Gene Name: cell migration inducing protein, hyaluronan binding
  ENST ID: ENST00000560027
  CDS Start-End: 1-437
ggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggtgagcaggcgcccacttggctgcaggaaagtggctcaacctcatcttgtccccttggcctttccaataagtctaagaacagccatgtagttaatgccaattaatgtaagacacctttctaggcattttgactctaaggctgactgtcccatacattaacgacatttttaaagctattaagctttaaaagtaaaataaacaccctattaaatata

SEQ ID NO: 116273 - DNA, 3536 bp, Homo sapiens
  Payload ID: 2679
  Gene Symbol: CEMIP
  Gene Name: cell migration inducing protein, hyaluronan binding
  Uniprot ID: Q8WUJ3
  ENST ID: ENST00000611615
  CDS Start-End: 237-3215
gcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgc

SEQ ID NO: 116274 - DNA, 2472 bp, Homo sapiens
  Payload ID: 2680
  Gene Symbol: CWH43
  Gene Name: cell wall biogenesis 43 C-terminal homolog
  Uniprot ID: Q9H720
  ENST ID: ENST00000226432
  CDS Start-End: 184-2283
cacactgcctcggttcggcaagtgggtcagttggctggggctcacttggcaacgggacgcgggaacgaggggcgcggacgcaggcccgggaggacgcggcggcgggaacctgggggcgcagggctagggcagcgggcccgacccgcacggctttcctggaaagcgctgcccctcgccgcggcgatgccctcgctgtggagagaaatcctcttggagtcgctgctgggatgtgtttcttggtctctctaccatgacctgggaccgatgatctattactttcctttgcaaacactagaactcactgggcttgaaggttttagtatagcatttctttctccaatattcctaacaattactcctttctggaaattggttaacaagaagtggatgctaaccctgctgaggataatcactattggcagcatagcctccttccaggctccaaatgccaaacttcgactgatggttcttgcgcttggggtgtcttcctcactgatagtgcaagctgtgacttggtggtcaggaagtcatttgcaaaggtacctcagaatttggggattcattttaggacagattgttcttgttgttctacgcatatggtatacttcactaaacccaatctggagttatcagatgtccaacaaagtgatactgacattaagtgccatagccacacttgatcgtattggcacagatggtgactgcagtaaacctgaagaaaagaagactggtgaggtagccacggggatggcctctagacccaactggctgctggcaggggctgcttttggtagccttgtgttcctcacccactgggtttttggagaagtctctcttgtttccagatgggcagtgagtgggcatccacatccagggccagatcctaacccatttggaggtgcagtactgctgtgcttggcaagtggattgatgcttccatcttgtttgtggtttcgtggtactggtttgatctggtgggttacaggaacagcttcagctgcggggctcctttacctgcacacatgggcagctgctgtgtctggctgtgtcttcgccatctttactgcatccatgtggccccaaacacttggacaccttattaactcagggacaaaccctgggaaaaccatgaccattgccatgatattttatcttctagaaatatttttctgtgcctggtgcacagcttttaagtttgtcccaggaggtgtctacgctagagaaagatcagatgtgcttttggggacaatgatgttaattatcgggctgaatatgctatttggtcctaagaaaaaccttgacttgcttcttcaaacaaaaaacagttctaaagtgcttttcagaaagagtgaaaaatacatgaaactttttctgtggctgcttgttggtgtgggattgttgggattaggactacggcataaagcctatgagagaaaactgggcaaagtggcaccaaccaaagaggtctctgctgccatctggcctttcaggtttggatatgacaatgaagggtggtctagtctagaaagatcagctcacctgctcaatgaaacaggtgcagatttcataacaattttggagagtgatgcttctaagccctatatggggaacaatgacttaaccatgtggctaggggaaaagttgggtttctatacagactttggtccaagcacaaggtatcacacttgggggattatggctttgtcaagatacccaattgtgaaatctgagcatcaccttcttccgtcaccagagggcgagatcgcaccagccatcacattgaccgttaacatttcgggcaagctggtggattttgtcgtgacacactttgggaaccacgaagatgacctcgacaggaaactgcaggctattgctgtttcaaaactactgaaaagtagctctaatcaagtgatatttctgggatatatcacttcagcacctggctccagagattatctacagctcactgaacatggcaatgtgaaggatatcgacagcactgatcatgacagatggtgtgaatacattatgtatcgagggctgatcaggttgggttatgcaagaatctcccatgctgaactgagtgattcagaaattcagatggcaaaatttaggatccctgatgaccccactaattatagagacaaccagaaagtggtcatagaccacagagaagtttctgagaaaattcattttaatcccagatttggatcctacaaagaaggacacaattatgaaaacaaccatcattttcatatgaatactcccaaatactttttatgaaacatttaaaacaagaagttattggctgggaaaatctaagaaaaaaagtatgtaagataaaaagaagagattaatgaaagtgggaaaatacacatgaagaacctcaacttaaaaaacacatggtatctatgcagtgggaaattacctccatttgtaaactatgttgcttaataaaaacatttctctaaa

SEQ ID NO: 116275 - DNA, 2390 bp, Homo sapiens
  Payload ID: 2680
  Gene Symbol: CWH43
  Gene Name: cell wall biogenesis 43 C-terminal homolog
  ENST ID: ENST00000513409
  CDS Start-End: 186-2204
aataaaggaaaagacctagattgaagtcttcaagctgagtctgcgaggcgcccgcgagagaccccgtcgcccgagttcccagcagccctgggattgtgcccaaggagcgcgaattctcctcgtgtcggccttgaccccgcgcggccggatgtgtttcttggtctctctaccatgacctgggaccgatgatctattactttcctttgcaaacactagaactcactgggcttgaaggttttagtatagcatttctttctccaatattcctaacaattactcctttctggaaattggttaacaagaagtggatgctaaccctgctgaggataatcactattggcagcatagcctccttccaggctccaaatgccaaacttcgactgatggttcttgcgcttggggtgtcttcctcactgatagtgcaagctgtgacttggtggtcaggaagtcatttgcaaaggtacctcagaatttggggattcattttaggacagattgttcttgttgttctacgcatatggtatacttcactaaacccaatctggagttatcagatgtccaacaaagtgatactgacattaagtgccatagccacacttgatcgtattggcacagatggtgactgcagtaaacctgaagaaaagaagactggtgaggtagccacggggatggcctctagacccaactggctgctggcaggggctgcttttggtagccttgtgttcctcacccactgggtttttggagaagtctctcttgtttccagatgggcagtgagtgggcatccacatccagggccagatcctaacccatttggaggtgcagtactgctgtgcttggcaagtggattgatgcttccatcttgtttgtggtttcgtggtactggtttgatctggtgggttacaggaacagcttcagctgcggggctcctttacctgcacacatgggcagctgctgtgtctggctgtgtcttcgccatctttactgcatccatgtggccccaaacacttggacaccttattaactcagggacaaaccctgggaaaaccatgaccattgccatgatattttatcttctagaaatatttttctgtgcctggtgcacagcttttaagtttgtcccaggaggtgtctacgctagagaaagatcagatgtgcttttggggacaatgatgttaattatcgggctgaatatgctatttggtcctaagaaaaaccttgacttgcttcttcaaacaaaaaacagttctaaagtgcttttcagaaagagtgaaaaatacatgaaactttttctgtggctgcttgttggtgtgggattgttgggattaggactacggcataaagcctatgagagaaaactgggcaaagtggcaccaaccaaagaggtctctgctgccatctggcctttcaggtttggatatgacaatgaagggtggtctagtctagaaagatcagctcacctgctcaatgaaacaggtgcagatttcataacaattttggagagtgatgcttctaagccctatatggggaacaatgacttaaccatgtggctaggggaaaagttgggtttctatacagactttggtccaagcacaaggtatcacacttgggggattatggctttgtcaagatacccaattgtgaaatctgagcatcaccttcttccgtcaccagagggcgagatcgcaccagccatcacattgaccgttaacatttcgggcaagctggtggattttgtcgtgacacactttgggaaccacgaagatgacctcgacaggaaactgcaggctattgctgtttcaaaactactgaaaagtagctctaatcaagtgatatttctgggatatatcacttcagcacctggctccagagattatctacagctcactgaacatggcaatgtgaaggatatcgacagcactgatcatgacagatggtgtgaatacattatgtatcgagggctgatcaggttgggttatgcaagaatctcccatgctgaactgagtgattcagaaattcagatggcaaaatttaggatccctgatgaccccactaattatagagacaaccagaaagtggtcatagaccacagagaagtttctgagaaaattcattttaatcccagatttggatcctacaaagaaggacacaattatgaaaacaaccatcattttcatatgaatactcccaaatactttttatgaaacatttaaaacaagaagttattggctgggaaaatctaagaaaaaaagtatgtaagataaaaagaagagattaatgaaagtgggaaaatacacatgaagaacctcaacttaaaaaacacatggtatctatgcagtgggaaattacctccatttgtaaactatgttgcttaataaaaacatttctct

SEQ ID NO: 116276 - DNA, 2135 bp, Homo sapiens
  Payload ID: 2680
  Gene Symbol: CWH43
  Gene Name: cell wall biogenesis 43 C-terminal homolog
  ENST ID: ENST00000514053
  CDS Start-End: 118-834
gaggggcgcggacgcaggcccgggaggacgcggcggcgggaacctgggggcgcagggctagggcagcgggcccgacccgcacggctttcctggaaagcgctgcccctcgccgcggcgatgccctcgctgtggagagaaatcctcttggagtcgctgctgggatgtgtttcttggtctctctaccatgacctgggaccgatgatctattactttcctttgcaaacactagaactcactgggcttgaaggttttagtatagcatttctttctccaatattcctaacaattactcctttctggaaattggttaacaagaagtggatgctaaccctgctgaggataatcactattggcagcatagcctccttccaggctccaaatgccaaacttcgactgatggttcttgcgcttggggtgtcttcctcactgatagtgcaagctgtgacttggtggtcaggaagtcatttgcaaaggtacctcagaatttggggattcattttaggacagattgttcttgttgttctacgcatatggtatacttcactaaacccaatctggagttatcagatgtccaacaaagtgatactgacattaagtgccatagccacacttgatcgtattggcacagatggtgactgcagtaaacctgaagaaaagaagactggtgaggtagccacggggatggcctctagacccaactggctgctggcaggggctgcttttggtagccttgtgttcctcacccactgggtttttggagaagtctctcttgtttccagatgggcagtgagtgggcatccacatccagggccagatcctaacccatttgggtgactgctggaatacaacattggaaggatttttggatcagactataacatattctttctttctcttataacagggacaatgatgttaattatcgggctgaatatgctatttggtcctaagaaaaaccttgacttgcttcttcaaacaaaaaacagttctaaagtgcttttcagaaagagtgaaaaatacatgaaactttttctgtggctgcttgttggtgtgggattgttgggattaggactacggcataaagcctatgagagaaaactgggcaaagtggcaccaaccaaagaggtctctgctgccatctggcctttcaggtttggatatgacaatgaagggtggtctagtctagaaagatcagctcacctgctcaatgaaacaggtgcagatttcataacaattttggagagtgatgcttctaagccctatatggggaacaatgacttaaccatgtggctaggggaaaagttgggtttctatacagactttggtccaagcacaaggtatcacacttgggggattatggctttgtcaagatacccaattgtgaaatctgagcatcaccttcttccgtcaccagagggcgagatcgcaccagccatcacattgaccgttaacatttcgggcaagctggtggattttgtcgtgacacactttgggaaccacgaagatgacctcgacaggaaactgcaggctattgctgtttcaaaactactgaaaagtagctctaatcaagtgatatttctgggatatatcacttcagcacctggctccagagattatctacagctcactgaacatggcaatgtgaaggatatcgacagcactgatcatgacagatggtgtgaatacattatgtatcgagggctgatcaggttgggttatgcaagaatctcccatgctgaactgagtgattcagaaattcagatggcaaaatttaggatccctgatgaccccactaattatagagacaaccagaaagtggtcatagaccacagagaagtttctgagaaaattcattttaatcccagatttggatcctacaaagaaggacacaattatgaaaacaaccatcattttcatatgaatactcccaaatactttttatgaaacatttaaaacaagaagttattggctgggaaaatctaagaaaaaaagtatgtaagataaaaagaagagattaatgaaagtgggaaaatacacatgaagaacctcaacttaaaaaacacatggtatctatgcagtgggaaattacctccatttgtaaactatgttgcttaataaaaacatttctctaaatt

SEQ ID NO: 116277 - DNA, 1974 bp, Homo sapiens
  Payload ID: 2681
  Gene Symbol: CREG1
  Gene Name: cellular repressor of E1A-stimulated genes 1
  Uniprot ID: O75629
  ENST ID: ENST00000370509
  CDS Start-End: 27-689
ccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcacgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgaaacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaa

SEQ ID NO: 116278 - DNA, 6383 bp, Homo sapiens
  Payload ID: 2682
  Gene Symbol: CREG2
  Gene Name: cellular repressor of E1A-stimulated genes 2
  Uniprot ID: Q8IUH2
  ENST ID: ENST00000324768
  CDS Start-End: 139-1011
gcgggggaccgcgcccggggatcctgcaggggcgggaagggggctcgggctccttgcttccgccgcagtggggcgctgccgggctccccggcactagcgctgctggcggccccggcggccgggcgtgctgcctgcaagatgtccgtgcgccgcggccggcggccggcgcggccggggacccgcctctcctggctgctgtgctgcagcgccctgctgtccccggccgcgggctacgtgatcgtgagctccgtgtcttgggccgtcaccaacgaggtggacgaggagctggacagcgcctccactgaggaggctatgcccgcgctgctagaggattcgggcagcatctggcagcaaagcttccccgcctctgcccacaaggaggacgcgcacctgcggccccgggcgggcgccgcccgggccaggccgccccccgcgccacccgggatgttctcctaccggcgcgagggcggccagacggccagtgcgcccccgggccctagactgcgcgccgccaccgcccgctccctggcccatgccagcgtctggggctgcctggccaccgtgtccacccacaagaagatccaaggactgccatttgggaactgcctgcccgtcagtgatggccccttcaacaatagcactgggattcctttcttctacatgacagccaaggaccccgtggtggctgatctgatgaagaaccccatggcctcgctgatgctgccagaatcagaaggggagttctgcagaaaaaacatcgttgatccggaagatccccgatgtgtccagttaacgctcactggccagatgatcgcagtgtctccagaagaagtagaatttgccaagcaagccatgttttcaaggcacccagggatgaggaagtggcctcgtcaatatgaatggttctttatgaagatgaggatagaacatatctggcttcagaaatggtatggaggcgcatccagtatttcaagggaggaatatttcaaagcagttcccagaaaggcctgatggagtgagaagaaagtccttggtgtttgcacttaaatgaaaaccttttcagtgatgcagccagacagctattgaccactgtctctttgttgaagggttcatagcagccctgccatccctgcagcagaatgagagagggtgaacagggaactctatgctagatttgagattaaagtggtcatttgcagatctccaactcacacagatacttcacgtagatagtctttattccattgtattcaatccagactcatcgattcagaaatcatataatagctggtggtcaaaatgacatgttgagatcattgttgtttcattgtttaaggaaaaaaaaaaatgcctgtacctacaatgtgattgctttgtattgtgagagtatctttgttgcttgctctgccaaatgcagtcttggttctaagttcactgtgaccacgaagcagctgactgtgcatcacgcagtcacaatattgtttttagggtgagggtggaggactgtgtgtccgtggattactcctcctgctggtggattgcagatgcattattaggtcatactggctagaatgcagcttttctcccaccataacatgaaaacagtgtaagaacatagggtgctttgtgcatagcccttctctatgtaagcagccatggcagtcattaaagagaaaggagtagctttgacattaagctccccagatccctgctgctcatacttctggcaagggttcccctctctcatgcatgaacaggggcatccaaaataagaagctctccattctgtggtggggaaagcggagaggggagtgggtgaagctgggaaagtaaaggcagcacgttacagaaggaagaaaggaagccagtaactgagggcccactgcctgcccggccctgggccaggccctcaacagaagccatctcatttaagccctgcaaccaatgagatgcacgtcatcattggctcttacagacaagaaaactagactcagaggggctgagtccacatcccagacagctcactgcagacacaggtggagtggttcctacaagacatccagttttaacaacaaaagagttattgaaatgcatgggtagaaattgaaccaggaaaatcagtaaagtgattgtaaaaaagaaggactagcttgcctggagatgatgtttcttgcttttggaaaaaaaaaaaaagtctctgaaatttgattcttactacagatttaaaactttctacatattatatgtaggagctcctagtgtttttgagaaattagactgtacctgtgtacacttctaaggtctacatggacctatgtatatatatctaagacctctgatcattaaaacctataaagggttgagctgtcccaagttttctgtctttctgtaatggctacaaactttctttggtaggttagggaggttgtataacataaaaaacacatcactatatgtaggaaatatacatttttcaagtaaataagagtgttattaatgattatgaacttttgcttaacaaaataacatacgacgagagcttgagttgtcaaaatatattttaattatctattgctaaaaacatagtaagatgcagagaattctttatttgtcataagccagtcctcaaaagagttcctaacagtagtgatttctaatatataagaataaggtacttctgagggaattttatattttcagagtttaaaattattgctactcccaatttagaaaaatggggagaaagctggaagaacaaatgacatgctcaaatgtattgcataagtcaacctcacaccttaatactgggagcttctctgcctcctgatcctgtcttgcagataaggtcccctggctaggtttgcgtttatagtcaggttccatttagctcattaaaggtcactgctgcttcaaaggactttgcccagtggatgccattcataaccactgatgaatgttatcagctatttatccaaattacaggaaatgaaacctgaaaaggttgggtaagaatagtgttgaaaattcacagttttaagtttgatggtctccattcaggcaagtgtgtttcagcaaatctctagaaatttacattgattaaaatgttagaggctgttctggaagttctagacatggcaataaggcaagaaaaagagattaaatgcatacagatcgaaagaaaaaaaaagtacccctatttagagatgagaggattgcctacatagaaattccaaataatctattttttttaaaaaaaaactctggaactagtatgtgagtgcaacaaggtctcaggacacaagatcagcatacaaaagtcaattgcatttctctatgctaacgatgaacatgtggggaaaaaaactaaaaacacaataccatttgcaatcactccaaagtgaaatacttccgtataaacaaaacttacccaggacctatgtagtgaaaatttttaaatgctaagaaaagaaattaatgacctaaacaaagaaagagagataccatgttcttggattggaagatacaaacagtaaagatatcagttctccccatctccatctctaggtttaatgcaattcctatcaaaatctcaacaaggattttgtagacctatacaagcttattttaaaagttacatggaaaggcacaggcattgaaatagctaaaacagtcttgtaaaagcagaataaggtaggagaaatcattctatttaatatagagttatgatgtagctacagtattcaagaagtgtggtatttggtggaggcatagaaacacattgatggaacagaatagggaatctagaaataggcccacacaaatatgctcaactgattttcttttacaaaagtacaaaactaattcaacagaggatagccttttcaataagtgtggagtaagtggacatccataggaaaataaaatgaaccttggactaaacttcataccttatgcaaaaattaactcagatcatatctgtaaaaataaaatgtaaaactataaaactataggatatagaaaatcttttggaactagggctaagcaaagggttgttagacttgataccaaaagcacaattcataaaagaaaatttgataaattaaacttcatcagaatttaaaacatttgttctgcaaaagaccatgttaaaaggccgagaagacaggccacatactgggagaaaatatttccaaaccacatatccaacaaaagattagtatctagaatatataaagaactgtcaaaactcaacagctaaaaaattctaattagaaaatggagcacatgaacagacatttcactgcagaggatataaaaatggcaaataagcgcatgaaaagacatgaaaagacagtcaacagcactagtcactaggggaactgcaaactaatactacaatgagatatcactacatagctaccaaaattgctaaaataaaaaataatgataacaccaaacgctgacaaggatgcagataaaccgggtcagtcatacactagtggtgggaatagaaaatggaacagccactccgcaaaaccatttgccagtttctcataaaactaaacatacaactgccatactgaccctcaattgctcctgggcatttatacaagagaaatgaaaagaggttcacacaaaaacttgtgcatgaatgttcatatcagttttatccataatgttcaaaaacttggagaaatcagatggcctttaacgggtggctggtgaaacagtggatggtgcctctatgcccggaatactactcagcgataaaaaagaactaattactgacatgggcaaccactgggatgaattccagagaattgtgctgagtgagcaaagccaatcataaaagtttgcacactgtatgattccatttacataacattttgaaatgcaaaattataggaatggagaatagattaggggttgccagggaggagtggggagaacaagagagttgggcataactataaaaggatagcacaagagatccttgtggtgatggacatattcagtatcttgaccaaatcaatgtgaaaatcctggttgggatattgtactgtagtttagcaagatgtgccattggggaaaactgggtaaaaagaacacaggatctctgtattatttcttacaactgcatgtgaatctacagttatctacaactatctcagaatctacaattatctctgagtaaaaagcttaacataaacaagatttagggcttagcttaataaagcatttatactctctctcttattagtccctaataaaatgaggaactgagctataagccaaaacctagtacaaagagacagcatttcatttgttaaccgttaatatatccatttgcagaagaggtgtaaaattctttaaaattttcctaaatatgttcaatttaatgttaaatacaaattaacaagaattcaacaaatctgctgtatagattttaagtgggtcacttaggaggagaggacatcttcgaatttctgatataaacacgttgagtaagctataggtgtatataagtatccaagtgtgtatataatgattctccactgattttatagagaagaactatatttccagtaatcttcccctaaatattgtgggaaataattctgttttagtgaataagctaattaaagtctatccagaccaccatgtttttatttacagtgactatatatatccatgattttgacatagagtataattctgatgttacttatttcaatatgccttgtatatattagctgtttataagagagtcgctttttggttgaaaagtatttctaggctgagcaaggtagctcatgcctgtaatccaaacactttgggaggccaaggcaggaggatcacttgaggtcaggagttcaagagcagcctgggcaacatagtgagacctcatctctacaaaaaatatttattaaaaaaaaaaaaaaaaaagcccagcatggtggtgcacacctgtagttctagctactcaagaggctgaggtgggaggattgctttgaggccaggagtttgacctcctgagctgtgatcatgccaccacacttgagtgatagagtgagactttgtctcttaaaaaaaaaaaaaggtatttctacaatttttccaaaaagtctgtatttatttaaataattgaactatcaaatactgttctgaaaataaaacctctctaggataatttattgatgcttatttgattgctataacagaaagtcaattattgtacaatttgaattgtaatgatgtgattatttgtgccatgtaatgcatgtaaaatgtaaaatctgttttcaaaactagatctatttaaccaaagactatttcattcctgatatgatttgtgtgcttgattaaatgaatttatgatattg

SEQ ID NO: 116279 - DNA, 772 bp, Homo sapiens
  Payload ID: 2683
  Gene Symbol: CRABP1
  Gene Name: cellular retinoic acid binding protein 1
  Uniprot ID: P29762
  ENST ID: ENST00000299529
  CDS Start-End: 106-519
aaggcgcgcagcgctgggcgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctcaaggcactgggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcaggagtttagccacttgggagaatgagaacaagatccactgcacgcaaactcttcttgaaggggacggccccaaaacctactggacccgtgagctggccaacgatgaacttatcctgacgtttggcgccgatgacgtggtctgcaccagaatttatgtccgagagtgaaggcagctggcttgctcctactttcaggaagggatgcaggctcccctgaggaatatgtcatagttctgagctgccagtggaccgcccttttcccctaccaatattaggtgatcccgttttccccatgacaatgttgtagtgtcccccacccccaccccccaggccttggtgcctcttgtatccctagtgctccatagtttggcatttgcacggtttcgaagtcattaaactggttagacgtgtctcaaccttt

SEQ ID NO: 116280 - DNA, 583 bp, Homo sapiens
  Payload ID: 2683
  Gene Symbol: CRABP1
  Gene Name: cellular retinoic acid binding protein 1
  ENST ID: ENST00000406419
  CDS Start-End: 1-340
cgacgagctgctcaaggcactgggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcagggtgaggccccagagccactacagcgtccccgtgtccccgctcggtgcccatggcccactgctgctggaggaacctgtgtctccctttgcagcctgtggcgcgccttccttgcaggagtttagccacttgggagaatgagaacaagatccactgcacgcaaactcttcttgaaggggacggccccaaaacctactggacccgtgagctggccaacgatgaacttatcctgacgtttggcgccgatgacgtggtctgcaccagaatttatgtccgagagtgaaggcagctggcttgctcctactttcaggaagggatgcaggctcccctgaggaatatgtcatagttctgagctgccagtggaccgcccttttcccctaccaa

SEQ ID NO: 116281 - DNA, 456 bp, Homo sapiens
  Payload ID: 2684
  Gene Symbol: CRABP2
  Gene Name: cellular retinoic acid binding protein 2
  ENST ID: ENST00000368220
  CDS Start-End: 209-456
gattcaagtgctggctttgcgtccgcttccccatccacttactagcgcaggagaaggctatctcggtccccagagaagcctggacccacacgcgggctagatccagagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaa

SEQ ID NO: 116282 - DNA, 783 bp, Homo sapiens
  Payload ID: 2684
  Gene Symbol: CRABP2
  Gene Name: cellular retinoic acid binding protein 2
  Uniprot ID: P29373
  ENST ID: ENST00000368221
  CDS Start-End: 97-513
ccagagaagcctggacccacacgcgggctagatccagagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagcccc

SEQ ID NO: 116283 - DNA, 992 bp, Homo sapiens
  Payload ID: 2684
  Gene Symbol: CRABP2
  Gene Name: cellular retinoic acid binding protein 2
  Uniprot ID: P29373
  ENST ID: ENST00000368222
  CDS Start-End: 156-572
cgcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaataaaa

SEQ ID NO: 116284 - DNA, 1033 bp, Homo sapiens
  Payload ID: 2684
  Gene Symbol: CRABP2
  Gene Name: cellular retinoic acid binding protein 2
  Uniprot ID: P29373
  ENST ID: ENST00000621784
  CDS Start-End: 209-625
gattcaagtgctggctttgcgtccgcttccccatccacttactagcgcaggagaaggctatctcggtccccagagaagcctggacccacacgcgggctagatccagagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgcttt

SEQ ID NO: 116285 - DNA, 519 bp, Homo sapiens
  Payload ID: 2685
  Gene Symbol: CEMP1
  Gene Name: cementum protein 1
  ENST ID: ENST00000565480
  CDS Start-End: 345-491
ttacgatagttacttttgttatgtattttaccacaatttttaaaaagcaaaccaaaaccaaccaagagtgcttcccccacacctcaaaatcatcctgcagcagctccctggcccagctctctctcaccctgaccctgggcccctctcccaccacccagggctagccctgtggaccaaccatctctgccagcccctccccgaccctccagccagggaggtggggcgctggccggtgaatggggcaggccaggcccaaaggctggcccagggctcaccagctctggactgggcgtcccgtctgaggtggggatgaccaacatgccagctctgggttttagctgaggatgggcacatcaagcactgacagccagcaagctgggcacaggcgatgctcaacctctaacacatcggctgagaacctcacctgcctctccctgcctgggagccctggcaagacagctcctctcccaggcccagcacaggcaggatgacactaatggggtgagcagggcacactgg

SEQ ID NO: 116286 - DNA, 1374 bp, Homo sapiens
  Payload ID: 2685
  Gene Symbol: CEMP1
  Gene Name: cementum protein 1
  Uniprot ID: Q6PRD7
  ENST ID: ENST00000567119
  CDS Start-End: 336-1079
ttacttttgttatgtattttaccacaatttttaaaaagcaaaccaaaaccaaccaagagtgcttcccccacacctcaaaatcatcctgcagcagctccctggcccagctctctctcaccctgaccctgggcccctctcccaccacccagggctagccctgtggaccaaccatctctgccagcccctccccgaccctccagccagggaggtggggcgctggccggtgaatggggcaggccaggcccaaaggctggcccagggctcaccagctctggactgggcgtcccgtctgaggtggggatgaccaacatgccagctctgggttttagctgaggatgggcacatcaagcactgacagccagcaagctgggcacaggcgatgctcaacctctaacacatcggctgagaacctcacctgcctctccctgcctgggagccctggcaagacagctcctctcccaggcccagcacaggcaggcgctggacagccacttcctaaggggtgcgcggccgtcaaggcagaggtgggtatccctgcacctcacacctctcaggaggtcaggatccacatccgtcgcctgctttcctgggctgcccctggggcttgtgggctgagatcaaccccttgtgccctgccccaggccctccctcaggcgaggccctgcccaggcaggtggttcttccctggctgttcccttccaacaggtggggcccagaccatcctatctctttggacctggagacatttccttaactgggctttgcagcagagggaagagaacagtggcagagccaggcgcgtacctcctgtgcccaggacagcacctgtaagcaagggggaagggagccacccaccccagaactcaaatggagagaaagtcaagacaatcacccctgacgtggggctgcaccaatccctgacgtctgaccccactgtggctgtcctcagagccaagagggctccagaagcccacccgcctcgaagctgttcagggagcctcacggcccgtgtttgccacatgggtgtgtgccagggccaaggggacacagaagatggcaggatgacactaatggggtgagcagggcacactggtgcctcccatactgccctccagcaccaggcagggtcaccacagccggcaagcactgggcctggggatgtgtgaagagatagggttattgagaagagaaaacagaacgctggtcatccgtggcactcagggctaggcagtccagggagcagaaaacaggggtcccgggcccagtctccctcctggaggtcagagcggagcccctggcactgtgccctggcccagaaccaggctgtgggctccacgctgcacaccccaactcaggagcagaaagcaaacccct

SEQ ID NO: 116287 - DNA, 2744 bp, Homo sapiens
  Payload ID: 2686
  Gene Symbol: CENPBD1
  Gene Name: CENPB DNA-binding domains containing 1
  Uniprot ID: B2RD01
  ENST ID: ENST00000314994
  CDS Start-End: 613-1176
ggcaggggcgcggcgccggctggggccccgtcttgggtgtccacgccgtcgcctgaccgttcgagggtttgatcgccagcgcagcctcgccctgcccagacagctgggccctaaggggatagccagcgcctttagacttatcttaaatcgggcatcggcatcaacacttatttctggggtcctccatggaaagcagctcccgaaacaacacccgcccggtccgccctccgctgcactggaaaaccgcccctggacgtttctgccgcagtgtccccctcacggagttccgtttgtctgcttggtcggttgttctctggagccccaggacccaggccgcttgtatgtgcctgcggccgcacggccccaacacgcggacttcgagcggtaccgggagacccgcgcggcctcctcggagtggacagtgaagcagcagctgggctaggcagtggggctgggcctgcccatggggacccgtccacgtctccaggacatcagcctgagcctcttcgcagcctcgttttctgttgaccgagttctgcaaggggacgtagaggaaccacagcgttcttgcgcttgagaccgctgtgattttctgacattttggaggcagaaatgcctggggaaaggcccacagatgcaactgtcatccctagtgccaaaagggaacggaaagcgattacccttgacctcaaattggaagtgttacgacgatttgaagcgggtgagaagctcagtcagatcgcaaaggccttagatcttgctatctctacagtggcgaccattcgagatagtaaagaaaaaatcaaagcgagttcacaaatagctactcctctgagagcctctcggttgactcgccatcgaagtgcagtgatggagagcatggagcagctgctgagcttgtggctggaagaccagagccagccaaatgcgaccttgagcgccgccatcgttcaggagaaggctgagtttgatgacttacagcgtgaacatggcgaaggttctcaaacggagaggtttcatgcaagtcaagggtggcttgtgagattcaaggagtgccactgtttgccccacttcaagatgaacagcgcagctcccagcaacaaggacatgtacacagaaatgctgaaaagcatcatcgaagaaggtgagtacaccccccaggtgtctttaacgtagatgagacgagacttgattggaagagaatgcccaaaggaacgtttatttccgaggaagagaatgctgagccagggtttaagtcatccaaagatcgcttgatgctgctgcttggtggcagtgcagctggggactttaagttgaagcccttactggtgtaccgctcagaaacccgcaaggctctgaagggttcttgaagcccagtttgcccgtgatttggcgctccaacagaaaggcttgggtgaccaggagcatctttcatgaatggttcacttactttttttgccgttgaaaaatacagtgcccaaaataatctcaccaacaaagcactgctcatactagacagtgcgtcatgccactctgtaaatttgagcgacctttctgataactaagagtagaataccttcaggccaggcgcggtggctcacgcctgtaatcccagcactttgggaggccgagacgggcggatcacctgaggtcaggagttcgagaccagcctcaacatggagaaaccccgtctctattaaaaatacaaatttagccgggcgtggtggtgcaggcctgtaatcccagctactcgggaggctaaagcaggagaattgcttgaacctgggaggcggaggttgtggtgagccgagatcgcgccattgcactccatcctggacaacaggagtgaaactccgtctcaaaaaaaaaaaagaaaaaaaagaagtacaagagtataataccttcatgacagtacagctgactcaatccggaccacgtgtcaaggtgtaatctcgaccttgaaagctcattatctgagaaggacttttcagcacatcctagaagcagcggatggtgaggacacagctatgatcagggaattttggagaaactacagcatcatggatgctgtggacatggccatcgcatgggaggagctcaaaccagcactaatgaacagcatgtggaagaagatttggcctgagtgtgttcaggcccagcgtttttcccaggcagataacattgcacagcttcaaaaaaacattgtgacccttgccagaaatgtggcctttgaagaggttgctgaggctgctgtggaccagttgctgcagtcccatgaagaagatctctcaaatgaggaactgatgcggctggaacaggagctggcagtgggggaggaggagagggaagatggtccctgggcactgtggcagctaaccacaggaagactgtcggcagccctctcacattttgaggctggcttgtaggtccttgctagtaacagccctaatgatgactggaaactgagaggttccagagaaatcagtgttgcagtaaactgctagcaggagctgtacaatgagaaaaagcgccactcaaaacaactctcttaggtcatttttcaatgtgtgtaaccaaaagttaatcagaataaagcggaagcaccatgatgacctcaacagtggaggcccagccaggcctccctgctctgtggtgttggacatccctggaaaccttgctgttggtatttccattttgatacttgagagcatcaaattttgtcattaaaatgttatttaaatata

SEQ ID NO: 116288 - DNA, 2058 bp, Homo sapiens
  Payload ID: 2687
  Gene Symbol: CTGLF11P
  Gene Name: centaurin, gamma-like family, member 11 pseudogene
  ENST ID: ENST00000624701
  CDS Start-End: 1-2058
atggggaacatactgacctgtcgtgtgcaccctagcgtcagcctcgagtttgaccagcagcaggggtcggtgtgtccctctgaatctgagatctatgaggcaggagctgaggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagaggcaagcacaatattacagaggaactctcaaacagatgctttggagtttaacccttctgccaatccagaggcaagcacaatattccagaggaactctcaaacagatgttgtagaaataagaagaagcaactgtacaaaccatgtatctactgagcgtttcagtcaacaatacagctcgtgttcgacaatattccttgatgacagcacagccagccagcattatcttacaatgacaataatatctgtgaccttggagatacctcatcatatcacacaaagagatgcagatagatctttgagcatacctgatgaacagttatcatttgcggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgtgctggtccaacctgtttacatctgagaaagggagtcacccagacaaagagaggaaagccccggagaatcatgctgacaccatcgggagcagcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcggcctctgcacccatctccagctctaaaagcaatggcctatccaaggacatggacaccgggctgggtgactccatatgcttcagccccagtatctccagcaccaccagccccaagctcaacctgcccccttctcctcatgccaataaaaagaaacacctaaagaagaaaagcaccaacaactttatgattgtgtctgccactggccaaacgtggcactttgaagccacgacatatgaggagcgggatgcctgggtccaagccatccagagccagatcgtggccagcctgcagtcatgcgagagcagtaaaagcaagtcccagctgaccagccagagcgaggccatggccctgcagtcgatccaaaacatgcgtgggaatgcccactgtgtggactgtgagacccagaatcctaagtgggccagtttgaacttgggagtcctcatgtgtattgaatgctcaggaatccactgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagtaaagtccacgagggaagagaaggaacggtggatccgttccaaatatgagaagaagctctttctggccccactaccctgcactgagctgtccctgggccagcacctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacagggtggacgtcatggcccgagatgcccacgggaacacagcgctgacctacgcccggcaggcctccagccaggagtgcatcaacgtgcttctgcagtacggctgccccgatgagtgcgtgtag

SEQ ID NO: 116289 - DNA, 4871 bp, Homo sapiens
  Payload ID: 2688
  Gene Symbol: CNTLN
  Gene Name: centlein, centrosomal protein
  Uniprot ID: Q9NXG0
  ENST ID: ENST00000380641
  CDS Start-End: 27-1202
aacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaaggatatggatattaccctggtcaggaaggaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaagtatgcttttattctgtaataaagatgtaaatgtttatgtatgaacttatgaacatatatagaattcagattttttcaaatttcagcatttaatttttacttccttttacatgtgtttcctcaaaatttagaagtgaaggatggttcaatttgataacatttaaaattttttgaattttctttatggtaattagagctgaatcacttaaaatatagatacaaacttactctatagggtattatttttataaattggcattcagacagcttctgtgaaacatactaggagtatagtctcaaaactggaatggaattcctcggcctgctattacaagaaattattttgtcaagtatggcagactttcattgtaaaatttgtacattatttttcggcaaatcttcacaaatacaaaggggattgctgaggagggctttaggatcaatattttccaggatttttctctgtttattttgtgtgtttctgttcagtagtcttttactttacagttgttttaggagcctttcaagaaggtttacccaagtatttaggtgtgctaactgactcagcagcaataatttaatctactaattaaaaaaaatacctttattggccgggcatggtggctcatgcctgtaatcccagcactttgggaggctgaggcgggcgaatcacaaggtcaagagatcgagaccatcctggccaacatgatgaaaccctgtttctactaaaaatacaaaaagttagctgagcatggtggttcatgcctgtagtcccagctacttgggaggctgaggcaggagaatcacttgaacctgggaggcggaggtcgcagtgagccaagatcgcaccattgcactccagccaggcgacagggggagacaacgtctcaaaaaaaaaaaaaaaaaaaaaaaaaacctttactgaattcttcatatgttttgtgtagtgtgctaaattattttaataaataatgtagtttatatagtgttattctcatttaatgatagtagttgaggcaagtgaggcttagagaggttaaataatacacagttcatattatccctctagaattactggatttttacttctgatcttacttttctaaaaaatcactgtgaaaatcgaatgtctataattaacatgaaattaattaccttaaaacttaaacacatatttttaaatgatgctttgtaacagtggttttcagtgtgtgttttgtgttgcctttgtgttttcccaaggacctagatgatagcaagcaggaagatacagtcttccacttcagctagagcagtgctgcctttttgttttatggggtgacattgcccactgtgttttttgtttctaaagcacgttccattgctaaaatgatttgaaacactgtactttattaatacttgttaattgttattaatactaattaattgttttctctttttcccccattgatgactttctgttgcttggaacattttttttctgttgcttgaaacatttttttcccctcttggcttccattgtactataattgggtggctttcttccttcagtttttagctgtccctttttaatttctttgtggtcctccccagtctccatgtcctgtaaagtgtgaaaatgttccaggcctcactcttaggatctctccttttttttctgtttatcctcacaccctaggtgatttcatctaatcaccttgactttcaaagttacactgcaggttcaatatcccttatctgaagtgcttggaacctgaaacctgaagtgcttcacatttttagcttttgagattttggaatatttgcattacatttactggctgagcatcccaaatctgaaaaattgaaatctgaaatgctccaatgagcatttcctttgagcatcatactggtgctcaaaaatgttttggattttggagcatttcagattttttgatttgtatgctctacctgtgtctataggctgatgattcccaaatttgtaaatttgtttatctaccttggatctcttctgtatactctaggaaagagtatatctaattgcctacttaatatctcttcacttggattcctaatgggcatctcatactgaacgtgttcaaaacaaagctattgccttttatgttttcagtacaggtgcagaattcgactacttcccaccacccttgctgtcaccattctgtccaggccactatcacatattacctggattattgcagtaacttgccagtttctttgttctgatcttaagccttttgacataggtgccaggatattattgccaaaactttgtgagtcaaatcagatcactgctctcttcaagtccctccagtggtttcccagaccattaaaaataaaaaacctaagttcttactacaacctgtgggactctacatgttccgactctacattacctctctgatctcatctttgccttcttttcttattcactccagcaacacaaaccatgtttttattccttgaacataacaggtatttaacctttcaaggtaatactttcttccagtgcctgaaagctttcctgcccagttatctgcatagataccattttacttcctttattctacaactcttacagtttaaaattagttgatagcagacattaaatggtagaagcaagaaaagaatgatgtatgttgtaatagtagtagagggaaatatgggagcataactgggggcctgttccaagactaaggataaagaaagctctccttgatggtgtcataccagtaatactttgctgagaagataagatatcaaagagacaaattaatttctgataacttttccaaatggactctagttcaaaccagaaattccctagtgtatgtctttactaaattgggagaagtagagcttatatgcccctatttggcgaacttgccgtaacctaaattgtgatctggggtacattttgaaaccgtaaacacttttcttctaggattatgtttatcccttccaagaatcattatagaaaatgagagatgtaaatgatggggttatgttgtgtttgtgaatgatattgaggcagaataaaaataaaagagaacaaactgagatgtgctaacctaataattggcttacttttccttgtgtttagtctgttttttgtcatttctttctctagattgaatatcatttttcttttatttttgtttctcagagattaccttggggagtgtgggagtagggggcttcactgatacttaagttgattctcactttgaaattgtacctcccactgtaatattttaattttgtagttgttttagatgcttgtagttgttcatacagttttcattagtatcctcaactagactcaatttgaaaatattcttcttatttatttattctttataaattttgtctacagttagtagacattacaattgttttggtggctgtatgtagttattttaaaaaacaaagtcttttataattccatctcccagaggcaaatactgtgaacattttgaatatttcacttttaaaaatgcatcttaacatatttgttagcacactagtatttttcactttaacattatattttaaaaaatcataacatataactattttagatggtcatataatttatttttctactgttggttatatatgttatttgttttactattgtaaataaagctgcaataaacatttctttgtcagttcagacta

SEQ ID NO: 116290 - DNA, 5576 bp, Homo sapiens
  Payload ID: 2688
  Gene Symbol: CNTLN
  Gene Name: centlein, centrosomal protein
  Uniprot ID: Q9NXG0
  ENST ID: ENST00000380647
  CDS Start-End: 85-4305
cggttcggcgttccgggctcgccgggttggggaaagggaggtggagtttccaacagggaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaaggatatggatattaccctggtcaggaaggaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaactttacaatgagttacatatttgttttgaaaccacaaaatcaaatgaagctatgctccggcaaagtgttactaatcttcaggatcagctattacaaaaagagcaagaaaatgctaagttaaaagaaaaacttcaggaatcacagggagcacctcttcctttacctcaagaaagtgatccagactactcagcacaggtacctcatcgcccatccttatcaagcttagaaacgttaatggtttcacagaagtctgaaattgagtatttacaggagaaactaaagatagcaaatgaaaaactgtcagaaaacatatctgccaacaagggtttctcccgaaagagcatcatgacaagtgctgaaggaaaacataaggaaccacctgtgaaacgttcaaggtctttgtccccaaagagctctttcacagactcagaagagctacagaagctgagaaaagctgaaagaaagattgaaaacttagagaaggcactacaactaaagagccaagaaaatgatgagctaagagatgcccatgaaaaacgcaaggaacggctacagatgttacagaccaactacagagcagtaaaagagcaattaaaacagtgggaagaaggcagtggcatgactgaaatcaggaaaataaagagagcagatccccaacaacttcgacaagaagattctgacgctgtgtggaatgaactggcatatttcaaaagggaaaaccaggagctaatgattcaaaagatgaatcttgaagaagaattagatgaacttaaagtacatatatctattgataaggcagcaatacaagaattgaatagatgtgtggcagagagaagagaagaacagctctttagatctggtgaagatgatgaggtcaagaggagtactccagagaagaatggaaaagaaatgttggagcagacattacagaaggtcactgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgtagaaaaagaaaatactgaacttcaagtaaaaatcagtgagctggagacagaagtcacttccctgaggagacaagtggcagaagctaatgcattgagaaatgaaaatgaagagctgatcaacccaatggagaaatcacaccagtcagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacctcagcaaggacggctgggaggatgtgagtgaaagcagcagtgattctgaagcacagacctctcaaactttgggaacaattattgtagaaacatcccagaaaataagtcctacggaagatggaaaagaccagaaagaaagtgatccaacagaagacagccaaacacaaggaaaagaaatagtacagacatatttaaatatagatggcaagaccccaaaggactattttcatgataagaatgccaaaaaaccaacttttcaaaagaagaattgcaagatgcaaaagagttcacatacagcagttcctactagagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaagaagctaaatttggatttggctgggcttcggaaagaaaaagaagatttactaaagaaattggagtcctcatctgaaatcacaagtttggcagaagaaaattcccaggtaacatttccacggatacaagttacatcacttagtccttcaaggagcatggatttggaaatgaagcaattgcagtataaactaaagaatgctactaatgaactcactaaacagtcatcaaatgtgaagactttgaaatttgaactcctagcaaaagaagaacacataaaggaaatgcatgaaaagatatctcgaatggagagggatataactatgaaaagacatttgatagaggacttgaaatttcgacagaaagtaaatttggaaagtaacaagagttttagtgaaatgttacaaaatcttgataaaaaggtaaagacattaactgaagaatgttccaacaagaaggtatcaattgattcactaaagcaaagacttaacgttgctgtaaaagaaaagtcacagtatgaacagatgtatcagaaatctaaagaggagttagaaaaaaaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacacagaagatcaagtggaaattgaaaaaacaaaaattgatgctgaaaatgacaaggaatggatgttgtacattcagaaacttcttgaaggacagcttccttttgcctcatatttactagaagcagtactggaaaaaataaatgaaaaaaagaaactagttgaaggatatttcacaattatgaaagatattagatgatattaaaatggagagctttattgcaaatgtgaaaactttttatgtggtgtgattggaatacatgcattgcaatcctgacacggtatctgctccaactatcaatagtcaggttcaataccaaaataagaagtctctgaaaataattaattgctgaacaagtgaaactaattaagtacatagccatttaaaaggaaatagtgtagcatctgatggtcgaatacaaatattgccacaaatcagtgcaaacttaaaaatgattttccttctagtgcattaaaagaaactgagcaggcttggtacacacaaattggcctgagcataagaagaaaaagtatcaactaaggatttaatgttttacgtttcatgaagaaactagactttttacataaaactgctatagatggccataagtggtccagggagcaacagatttgtagtatgagcaaatataaaatgaagcatcataacttgagcatttattgaaataaattgtgtggtccaattgaatctgttctcattgatgtgctggtttatgtaggagatactgtgtatttctacaactctttggcaaaaacaaaaacattttcttcttctctctcttaacttcacaatactatacgttgtgtagtcatataaatttgcagggaaccacaaacccaatgtataaaattaggctctatttaacagaactactactgtggtcagctaatttaagttacattcttaaccatgatgtcatccttatttagattcctggacattcccacctcatttcacctcttcaccgtgttcctgccataccctttttggttcctctaattcaccatactggtgcctgcctcccacatttgcccttggtcttctctctttctagaatactctgcactcaactttcctcatggctggctccttgtcatcattcagctccaccttccccggtccctcagagacacattctctgaccagcttactattttatttcctcatagcacaaaattatctatctgttcatgtatttgttttcttgtttattttcttcttttccctctttagtatgtaggtcccatgagattaaggcaagggttggcagattatagcctgcagggcgaatctggcctgccacctgttttgtatggcccacaagctaagaatggtttttgccttattaaatggtttttaaaaaatcaaaaggagaataatattttgtagcatgtgaaaattatataaaattcaaattttggtgtctgttaataaagttttattggaacaca

SEQ ID NO: 116291 - DNA, 1758 bp, Homo sapiens
  Payload ID: 2689
  Gene Symbol: CETN1
  Gene Name: centrin, EF-hand protein, 1
  Uniprot ID: Q12798
  ENST ID: ENST00000327228
  CDS Start-End: 53-571
gaatgagagcgcggggcggtgccgttgggaccacggcggccagagcggcaggatggcttccggcttcaagaagcccagcgctgcctccaccggccaaaagagaaaggtggcacctaagcccgagctcactgaggatcagaagcaagaagttcgggaagcatttgacctcttcgacgtggacggaagtgggaccatcgacgcgaaggagctgaaggtggccatgagagcgctgggcttcgaacccaggaaggaagagatgaagaaaatgatctccgaggtggacagggaaggcacggggaagatcagcttcaatgacttcctggccgtgatgacgcagaagatgtccgagaaggacaccaaagaagaaatcctgaaggccttcaggctctttgatgacgatgagaccgggaagatctcgttcaaaaacctgaagcgtgtggccaacgagctgggggagaacctcacggatgaggagctgcaggagatgatcgacgaagctgatcgggatggggacggcgaagtgaacgaggaggagttccttcggatcatgaagaagaccagcctttactgaagtcggttcagaagctaaagtgactctctgggttgcctgcttccattttgtgaaaccttagaggacagcggctgcctgtcccttcttcaccccctcacccccataatttgtctagatctatttccatatctctagttcaataatagaatttgaaagatgcttgtaatgtgagttttgggttttaattctcaagagtcaacctggagcacatgaggttaaacaaagggccctgaagtttgagtgcgccctccatttgccctgtgctgaacttgctgttcatctgttgatctggaggcaggacagcttctgggacacacaaaaatgtggttccctttgtcacttctttggtggtcttaaattatcttgcttcatatatcattccttaaattccagtcattgttccagcataatgagatggaatctgccagtagatttgcctagcctgtccacttagctgaataccagtttgaaggaaaacagggtggccacttacaaacttacggagctcaggacagataatcttataaagaatagacttgcttgggtggtagtacgttgtgcaattttgactattcactggctttatacctgcaaatgattcttcgttcatgtgtaaattgtccaccatgggtttatctagggctagtatgtatacctgggctacagaataaaaataaaatctaatactggcccaagcaaagtataatttgcttaagaggttacgctaacaaacgattttgagtaaatatttacaaatgtaggatcttagtttaggaaattataacaaataccttaatataacattttaagctacttatagtccttggaaatagcaacaaatatcttagttattggactattataaccttagtcatcttattactgcttgattatgagacactctccctgctaatccttagaacatcttggttcttggtacttgacttttagcccctctgacatatagttgatgtcagagtgtctggcatttcagtagtgctctattttacaaatcccagtaaactgctccactgtggcttgtttatgtgttaatactgcttgttttctgttataaattattttttgctttggagtaagatatcatcattttgcatagctacaaatctgaagttaaagaaaattttaaaaatgtaattgtgggaaaataacaaatagatctgctgaga

SEQ ID NO: 116292 - DNA, 1454 bp, Homo sapiens
  Payload ID: 2690
  Gene Symbol: CETN2
  Gene Name: centrin, EF-hand protein, 2
  Uniprot ID: P41208
  ENST ID: ENST00000370277
  CDS Start-End: 68-586
ggtgggaacggcgccgagtcagtgtacacgtcggttgcctaacaaccggcagcggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaacctttctcagtttgaacttgtattctctaaggatgagttctttagctttgcttatgagttcctcttctcaattattgtgttgaaggcagcctattagatacaaaactccttaccagcctatggacagaaaatgaataatcctttgctactttcctggcatgaattgctttttgccttggaaggctgctggtttgtaaaactagcagaatttttatatcacctaagcctaaatgatgctctaaaaatagttttggcaaagctaagactggaaaagagtcttgttagtaatttgtgcttgaataaaatggggagagccaggctaacgcaacactaggatggattcagccaacctctcgtgaatttatttgct

SEQ ID NO: 116293 - DNA, 2432 bp, Homo sapiens
  Payload ID: 2691
  Gene Symbol: CETN3
  Gene Name: centrin, EF-hand protein, 3
  Uniprot ID: O15182
  ENST ID: ENST00000283122
  CDS Start-End: 126-629
atgttgtgggaggtccctgaggccgctgaggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttgtgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaataaaccaagaggagttcattgctattatgactggtgacatttaaagaattacaaggataaacactaagaatgttgcagttaccatcttatattctatttttgtgcctggagccatgtgaaaaaaaccaacttagttcttttatcctaaaggaccaaaaataagcatcttatatatctgtattttactactgttaagtttctttgtatgaactgtgttgttagtactcagatagtttagctttgtatttataatagagcttttatataaagttttaaaaattgaatgtgtgatatgtgttctttgaaggttttttaatttaacatttatagtcactttttagtgcacacattttccagactttcgttaataaaatatttattttattagaattttaaagtttggtaaatttgtttttattcctagtatctgttaaccctcaagagtggatttcttaaatcttccctttataattttactagtttctgaaacaaaaattgaaatacaattagcaatagagtggcacatttttccattacctaacatttcatcaattttgacattctatattttaatacaagctgactcaatataagcctaattccttttttaagagtcctgtctttgagtttagaaggaataagtattgtgcagatagacccatttatccttgtgtattatgtttcttaacttggtatcattgtaagtatgaaagttaattttcttctgaatatttccttaaacaaattgaatgaatacaatttgaattttctaacttcttgactgagagatttaaattttggaattttgatttgttaaggtaattatcactcaattacatgtcacagtgatgaaaatagaaaactgtaagccacagaaataatttaagtctatgttttacctatatgaaggaacagtctgtgattcaccaggaaatagtagagacacagtttccaagtactggtgggctcttctgccttgtagaagtgtatgttagggggaaacaagtggttatggagatcgatcatagaaaaaaatagtacctatatggatccttcactcatatctagtactcggtgttatgggctctcccaggaacggaattgagttgtctatttcagcaatctttctttagaattcttgttttaaatttttaagtttaaagtgtagtatcatttgaggcgctttaaatgttgtgagccttttaagagtattacattaagggttgtccactagaaatttaacacaaaatcagtagggaatactatagcagtagtgacatttcaaacagttatctaggaagcaagtgtatattaagtcattcttgtattgctacgaagaaatacccaagactgcatattttataaagaaaagaagcttaattggcttacggttctgcaggctttacaggaagcatggtgcttctgcttttggggaggcctcaggaagcttacagtcatggtagaaggcaaagggggagcaggcacatcacatggtgaaaaccagagtgaacaagtgagagaagtgccaagtactttgaaaccaccagatctcatgagaactcactattgtgaggacatctaatcacctcccaccagacctcacctccagtactggggattacaattcaacatgatatttgagtggggacagatatacaaactatatcagcaggttaactagagtaaaacttaattttgaatacaaattcaatggtcacagtcattatattcagggcaacagaccttgaaattaaaaaatttttgtcgcacactgatgagttccctctgtcttgatcatgaaatatattgatttccaggaaagtgaaaaataaaacagtaaaagtaaa

SEQ ID NO: 116294 - DNA, 1026 bp, Homo sapiens
  Payload ID: 2691
  Gene Symbol: CETN3
  Gene Name: centrin, EF-hand protein, 3
  ENST ID: ENST00000522083
  CDS Start-End: 97-672
ggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttgtgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaattcttaagaacatactcttgcttcctatttggtctagatgcctcagtctaaatcgggagttcttcagtgaagtaaaccaagaggagttcattgctattatgactggtgacatttaaagaattacaaggataaacactaagaatgttgcagttaccatcttatattctatttttgtgcctggagccatgtgaaaaaaaccaacttagttcttttatcctaaaggaccaaaaataagcatcttatatatctgtattttactactgttaagtttctttgtatgaactgtgttgttagtactcagatagtttagctttgtatttataatagagcttttatataaagttttaaaaattgaatgtgtgatatgtgttctttgaaggttttttaatttaacatttatagtcactttttagtgcacacattttccagactttcgttaataaaatatttattttattagaattttaaag

SEQ ID NO: 116295 - DNA, 610 bp, Homo sapiens
  Payload ID: 2691
  Gene Symbol: CETN3
  Gene Name: centrin, EF-hand protein, 3
  ENST ID: ENST00000518458
  CDS Start-End: 1-246
gagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaatgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaataaaccaagaggagttcattgctattatgactggtgacatttaaagaattacaaggataaacactaagaatgttgcagttaccatcttatattctatttttgtgcctggagccatgtgaaaaaaaccaacttagttcttttatcctaaaggaccaaaaataagcatcttatatat

SEQ ID NO: 116296 - DNA, 664 bp, Homo sapiens
  Payload ID: 2691
  Gene Symbol: CETN3
  Gene Name: centrin, EF-hand protein, 3
  ENST ID: ENST00000522842
  CDS Start-End: 106-441
ggccgctgaggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttggtgtgtattttaatagtctttgtaatcagcagctgttaggaaattgtctgattaatatcactttttaaattttaaattctctaggttatggaattttcttatagaacactggtgtataatgtgactcttactcagttttgttttgttggtttttttttcaaagaaaaaatatggctttgctctgagatttatagttttgtcttttgttttgttgtgaagattctaaccaaggaactattgtgtagctttttatagaaagatgcttttccaagttgtttgtatttatattat

SEQ ID NO: 116297 - DNA, 738 bp, Homo sapiens
  Payload ID: 2691
  Gene Symbol: CETN3
  Gene Name: centrin, EF-hand protein, 3
  ENST ID: ENST00000522864
  CDS Start-End: 72-533
gtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttgtgacagactggatattggaaagagatccccatgaagaaatactcaaggcatttaaactatttgatgatgatgattcagttcttaagaacatactcttgcttcctatttggtctagatgcctcagtctaaatcgggagttcttcagtgaagtaaaccaagaggagttcattgctattatgactggtgacatttaaagaattacaaggataaacactaagaatgttgcagttaccatcttatattctatttttgtgcctggagccatgtgaaaaaaaccaacttagttcttttatcctaaaggaccaaaaataagcatcttatatatctgtattttactactgttaagtttctttgtatgaactgtgttgttagtactcagatagtttagctttgtattta

SEQ ID NO: 116298 - DNA, 867 bp, Homo sapiens
  Payload ID: 2691
  Gene Symbol: CETN3
  Gene Name: centrin, EF-hand protein, 3
  ENST ID: ENST00000522565
  CDS Start-End: 97-567
ggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttgtgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaagtaagttttaagtgaaacgtattttccaggttttcctgatgctacacatgtaatacatttttctaaaaccaaatgacttgcaagacttttttgtaaacttaactgcttcttgtaatggaccttctgtctaaataattcacatattcaatttagaatgaagcagatctctaaaaccaattatacttcaagaaggtccttcacttttctctgaaggtgaaaccaccaaaatttcagcctttcaatataatttcagtctttaatggcttctccctcaacctacatgctaagttctaagttctattgattttccc

SEQ ID NO: 116299 - DNA, 5446 bp, Homo sapiens
  Payload ID: 2692
  Gene Symbol: CCP110
  Gene Name: centriolar coiled coil protein 110kDa
  Uniprot ID: O43303
  ENST ID: ENST00000381396
  CDS Start-End: 248-3286
cagcccgggaatcaaccaccggaagtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatcaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcacaaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaaggaacccctaagacatcagtgaagggggttgtgcaaaatagacagaagccttcacagagcagagtgcctaacagagtgcctgtttcaggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 116300 - DNA, 5151 bp, Homo sapiens
  Payload ID: 2692
  Gene Symbol: CCP110
  Gene Name: centriolar coiled coil protein 110kDa
  Uniprot ID: O43303
  ENST ID: ENST00000396208
  CDS Start-End: 47-3022
acattaaaaataacatttttctctcttgtagtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatcaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcacaaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaagggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatctt

SEQ ID NO: 116301 - DNA, 5549 bp, Homo sapiens
  Payload ID: 2692
  Gene Symbol: CCP110
  Gene Name: centriolar coiled coil protein 110kDa
  Uniprot ID: O43303
  ENST ID: ENST00000396212
  CDS Start-End: 437-3412
aatgcacctcggggatggtagtgttctggtggcccaacggttttaacagcccgggaatcaaccaccggaagtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatcaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcacaaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaagggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 116302 - DNA, 698 bp, Homo sapiens
  Payload ID: 2692
  Gene Symbol: CCP110
  Gene Name: centriolar coiled coil protein 110kDa
  ENST ID: ENST00000565376
  CDS Start-End: 549-698
gttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtttcatttgaaacctacggggaaccaagcactgtcgctgccctccaggaattcatactctactgctaaaaatcgtcatcatcattatcctcttaataagaaaagcagtccccattatttgttgctttctgcgtgttctgcactacgttaattgccctacatgcattagctcattgaattcttacaacattcctttgagacggataccgtgatcatccctcttttacagaggacgaaacagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactggtaaacttg

SEQ ID NO: 116303 - DNA, 595 bp, Homo sapiens
  Payload ID: 2692
  Gene Symbol: CCP110
  Gene Name: centriolar coiled coil protein 110kDa
  ENST ID: ENST00000562083
  CDS Start-End: 144-302
atggcggggaggaggaggagaaggcggcggcggaccgagctgcgctctgtcagtaccatttgagccattcgcttcctgacaaggcccgtggcgaggggagaggagctgaaggggccgtgggggatcagtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggt

SEQ ID NO: 116304 - DNA, 360 bp, Homo sapiens
  Payload ID: 2692
  Gene Symbol: CCP110
  Gene Name: centriolar coiled coil protein 110kDa
  ENST ID: ENST00000561888
  CDS Start-End: 1-360
agaatacaagaagcatcactatccacagagagctttctccctgctcagtctgaaagtatctcacttattcgctttcatggagtggctatcctttctccactggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagt

SEQ ID NO: 116305 - DNA, 5121 bp, Homo sapiens
  Payload ID: 2693
  Gene Symbol: CCSAP
  Gene Name: centriole, cilia and spindle-associated protein
  Uniprot ID: Q6IQ19
  ENST ID: ENST00000284617
  CDS Start-End: 79-891
agaggatcggccgggcgcggcgggaaggaggctgcgggcagcgaggagcggctggcgctcgaggcggcggacggcaccatgtccccggggagcggggtgaagagcgagtacatgaagcgctaccaggagccgcgctgggaggagtacgggccgtgctaccgcgagctgctgcactaccgcctaggccgccggctgctggagcaggcgcacgcgccctggctctgggacgactggggcccggccggctcctcggaggactcggcgtcgtcagagtcgtcgggcgccgggggccccgcaccccggtgcgccccgccctcgcccccgccgcccgtagagccggcgacccaggaggaggcggaacggcgggcgcgcggggccccggaggagcaggacgcggaggccggggacgcggaggccgaggacgcggaggacgcggctctgccagcactgccagtgaaagatgtagaagataaacctgaacaacaaaccagaacaagagagactgacaaatcacccaccagtactgagcctcgacagcaaccaagtgccttatttgctagaggaaacaggaaagcggtcaaaagtccccaaagatcatcgagtaaaataaaagaaaacaagcatccatttgctctttatggctggggagaaaaacagaccgatacaggaagccagaagactcacaacgtctgtgcgtccgctcctgtgcacgagattcatgaatcagcattacgagccaagaacagaagacaggtggaaaaaaggaaactggttgctcaaaggcagcgagctcactctgtggatgtggagaagaacagaaagatgaaggcttcctcctcagagaacccgtggatgacagaatacatgaggtgctattcggcaagagcttaaagaaacacttgcgtggacagcctcttttaaaaagtgtaaatgactgaaaggaaaaacaaaacaaaaaccatcaaaagaaacggacacaggtttaagaaaccaactgattatgcaaggttttttttagggaatttgtaaaagattgttttattttgatgaatattggtcacctacctcggcagtagggcagacagttgaagccatagacatttggttatttatgaagataattccctaaatctttgatattcttataaggtttttgttttaaagcatcttaatcttttaagatactgacaccaaatgcctttaaatggcaacagatgcttacagttcagtattcttttcataagcttaggtagagcctattatcatcttgttctaaataactttccagattccatagctataagatcattccatcctacagcataagactcgttttccttatatgccgttttgtttgtgaaagaatatcaagtcaaaaatgagtgtcagcactactactgattccatgtataatgaaagtagaactttgctagttcctgaaaatttttaacttatttgtatttcagttcagcagcatctttatgtagattgtgatatttaagaattatctgggctgggcgagggtctctttttctctttcagtgatcatctaggcagttattatttaatagtttaatagctcaagtacattccaatagacgaagtgcacacaacacaatatgtgtgtacagtagtagtaaagtttcttttgagtagtcaaagactcactttttttattgcctttttttttttttttaaagaatacatactgtggattcagtcccttgtcacacttgaccttttggcatacacccactgtggacttttgcctcttctgtaatggctggcaatgacatttcaaacttacaatctggaattgcacttggtacattggcattgcttgttccactgggatggggaccagtgtgaagatgcctgttagatagactgcccacccctactttctctttttctttatagcacttaacaataacaaagtcttgatgatgtacagtattcaaactttaggttgaaatacgttactctttgattcctagccagtagatcttatctacactttaatgggagagaatggtggtgtgtgggtaggcacaaatttatgtaaatagtgctccttctctttagtatgtttgctttgggggtagaaaaatggttttaacaaacactggtttccatcaaatgaatgatgtcttctccatcctgtggagacaagaatctgctagaaggatatgtgctaagttccttataagagataatggtgctctgcctatgccagcttggcacccgaagatgtgtgagtggacgtgaggctgagtattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattgagatgtatatttcaaaagaggaaattttacatgttgtccaaaacagccttgctagtaactggtgaattttggtattaactattattaaagtctttaaacgacacaggtacctaaagatcaccttaatgtggcaatttgtgatggtgtagctagctgattgtgaaaactgttcctttaaagtcgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccagacttttctcttgtttagaaaacaaacttatatttaatgtacttactacttaaaactccagacagagatataatgtagaaggcaaatattggccaattttttcctctttttaagtggaagacaaatgaacgggatttttaaagtgcttttaaagtgcatgaatggttaataaatcagtatgaattgtaagccttcatcttacatccaagtccttagttggttagggtttcttttctttcttttttaaagagtgtcaattaccttttgaacctgtgaaaatttgatagttgttaacagtctgatggtcctaattctttcttttcattctagaaatgaatgtggttgtaatcatgttcctaattcttgggacaacctgcaagacagtgagacagtttaaaaattacctttcatgttgaaaaagtctgaaacagagaacccaatgatatttaaaataaatgctacataaaactctttttaaaattttgattttaacttaattaaaacaatgtcataaatatgctttttgattttgttactgcttttaatattaaagtaatagaatattgaagcaatattgtctagcactctgctggacattaagtccgcgggaggagaagtgaacaggaatcgattctttgtcttttaactgcccttagttaggagatgttaaaatacttggcacctctggttatatgtatgttatgtgtgttctcccccctaaaatttctaagcacatttattcacttttaaaatgaatctttaaaagattatagttagtagttatagttaatattctatttacttggaaaaatgtgaataaatggatcttcaaaagattcattttaaaaatgaataaatgtataataggctataggtgatcttacttgcgtattaggtaggaggcacatatttataccatttcatatgtaatatctttgtcattgtgtttcatcgaagatcaattgctagcaacttgaagggtatttatacttgggtcacttgaactcagctgactaaattgtaagaacgagagcaagcaagatggctgttattggaagccataacttccagaagataattctgcacaattcgtaagttaaaaaaaatctgtagggtcttccactatcctttttcaggttgataatgctgttctgggcacacactttgtaaatggaatgttatggtacagtcgcctctcagtatccatggggcattggttccaggcctcccttaggatgccaaactccatggatactcaaaccccttctataaaatggtgtagtatttgcatatatcctagacacatcctcctgtatgctttaaatcatctctagattacttaaaatacctaatacaatgtaaatgctctgtaaatagttgttatactatattgtttagggaataatgacaaggaaaaaaaagcctgtacatgttcagcacaagtgaaaccatcctttttgcccccaaatattttcaatttgtatttggttgaatccatggatgcagaactcacggatacagagggccgactgtactttctttaaagtgttcaaaagtattactagcaaagaggaggaggagcaaagcatatatcagaagtaaaacaatttttcttgttgactgctttggtaaaaaacagtttgatggatagttttacatttcactggactagataaaaaatggtgctaatatttatgtagcttgatgctatagttgctttggtatcaaacttaatacctaacccatataagatccttattatataattttgtgatcagtaaaatgatattttaaagagtgatcttaaaaatatgacctggtcattgcacaacgtttgcatttgaaatgaatttttgtactatagggtggatatggagttattcagtgcaagtgtgtgcttaatatcaaaccctatgcaaggagctatgtctagatttttggtccaaatttgcctccttcaagcctactagtgtgagatggaaaaaaatcgattgctcttttaatattatttccattttgaaattctcgacacttgaatgaaggcagtagaggcctctttttggatttctcttctaataacaaaactttatttagggaaggtttccctgtgctatcgtaagtttgttttgagcactgcattcactttaaaattctggaggaacaaaggctgggcacataatcacaaagcccaggccacacaataattcggggttgtattttctaagaactatgtattgtttttagcttatagttaatattgtatttacttggaaaaatgtgaataaagttaattaacattacaagctgaga

SEQ ID NO: 116306 - DNA, 4399 bp, Homo sapiens
  Payload ID: 2693
  Gene Symbol: CCSAP
  Gene Name: centriole, cilia and spindle-associated protein
  Uniprot ID: Q6IQ19
  ENST ID: ENST00000366686
  CDS Start-End: 209-679
ctgctagaaatgcaaataacagaaggtggagggggtagggaacatgccttccagattattcctgtgggtactgatctgctagctaaattgagatgtactttatcaggctaaatggcttttctctccccgatcttttattgtttgtgatggagttgtcaaatatttgcatgcaatataaatacaatttttaggcagcgttgtgatatggatggtgcctgtatttaccagctcagcactgccagtgaaagatgtagaagataaacctgaacaacaaaccagaacaagagagactgacaaatcacccaccagtactgagcctcgacagcaaccaagtgccttatttgctagaggaaacaggaaagcggtcaaaagtccccaaagatcatcgagtaaaataaaagaaaacaagcatccatttgctctttatggctggggagaaaaacagaccgatacaggaagccagaagactcacaacgtctgtgcgtccgctcctgtgcacgagattcatgaatcagcattacgagccaagaacagaagacaggtggaaaaaaggaaactggttgctcaaaggcagcgagctcactctgtggatgtggagaagaacagaaagatgaaggcttcctcctcagagaacccgtggatgacagaatacatgaggtgctattcggcaagagcttaaagaaacacttgcgtggacagcctcttttaaaaagtgtaaatgactgaaaggaaaaacaaaacaaaaaccatcaaaagaaacggacacaggtttaagaaaccaactgattatgcaaggttttttttagggaatttgtaaaagattgttttattttgatgaatattggtcacctacctcggcagtagggcagacagttgaagccatagacatttggttatttatgaagataattccctaaatctttgatattcttataaggtttttgttttaaagcatcttaatcttttaagatactgacaccaaatgcctttaaatggcaacagatgcttacagttcagtattcttttcataagcttaggtagagcctattatcatcttgttctaaataactttccagattccatagctataagatcattccatcctacagcataagactcgttttccttatatgccgttttgtttgtgaaagaatatcaagtcaaaaatgagtgtcagcactactactgattccatgtataatgaaagtagaactttgctagttcctgaaaatttttaacttatttgtatttcagttcagcagcatctttatgtagattgtgatatttaagaattatctgggctgggcgagggtctctttttctctttcagtgatcatctaggcagttattatttaatagtttaatagctcaagtacattccaatagacgaagtgcacacaacacaatatgtgtgtacagtagtagtaaagtttcttttgagtagtcaaagactcactttttttattgcctttttttttttttttaaagaatacatactgtggattcagtcccttgtcacacttgaccttttggcatacacccactgtggacttttgcctcttctgtaatggctggcaatgacatttcaaacttacaatctggaattgcacttggtacattggcattgcttgttccactgggatggggaccagtgtgaagatgcctgttagatagactgcccacccctactttctctttttctttatagcacttaacaataacaaagtcttgatgatgtacagtattcaaactttaggttgaaatacgttactctttgattcctagccagtagatcttatctacactttaatgggagagaatggtggtgtgtgggtaggcacaaatttatgtaaatagtgctccttctctttagtatgtttgctttgggggtagaaaaatggttttaacaaacactggtttccatcaaatgaatgatgtcttctccatcctgtggagacaagaatctgctagaaggatatgtgctaagttccttataagagataatggtgctctgcctatgccagcttggcacccgaagatgtgtgagtggacgtgaggctgagtattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattgagatgtatatttcaaaagaggaaattttacatgttgtccaaaacagccttgctagtaactggtgaattttggtattaactattattaaagtctttaaacgacacaggtacctaaagatcaccttaatgtggcaatttgtgatggtgtagctagctgattgtgaaaactgttcctttaaagtcgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccagacttttctcttgtttagaaaacaaacttatatttaatgtacttactacttaaaactccagacagagatataatgtagaaggcaaatattggccaattttttcctctttttaagtggaagacaaatgaacgggatttttaaagtgcttttaaagtgcatgaatggttaataaatcagtatgaattgtaagccttcatcttacatccaagtccttagttggttagggtttcttttctttcttttttaaagagtgtcaattaccttttgaacctgtgaaaatttgatagttgttaacagtctgatggtcctaattctttcttttcattctagaaatgaatgtggttgtaatcatgttcctaattcttgggacaacctgcaagacagtgagacagtttaaaaattacctttcatgttgaaaaagtctgaaacagagaacccaatgatatttaaaataaatgctacataaaactctttttaaaattttgattttaacttaattaaaacaatgtcataaatatgctttttgattttgttactgcttttaatattaaagtaatagaatattgaagcaatattgtctagcactctgctggacattaagtccgcgggaggagaagtgaacaggaatcgattctttgtcttttaactgcccttagttaggagatgttaaaatacttggcacctctggttatatgtatgttatgtgtgttctcccccctaaaatttctaagcacatttattcacttttaaaatgaatctttaaaagattatagttagtagttatagttaatattctatttacttggaaaaatgtgaataaatggatcttcaaaagattcattttaaaaatgaataaatgtataataggctataggtgatcttacttgcgtattaggtaggaggcacatatttataccatttcatatgtaatatctttgtcattgtgtttcatcgaagatcaattgctagcaacttgaagggtatttatacttgggtcacttgaactcagctgactaaattgtaagaacgagagcaagcaagatggctgttattggaagccataacttccagaagataattctgcacaattcgtaagttaaaaaaaatctgtagggtcttccactatcctttttcaggttgataatgctgttctgggcacacactttgtaaatggaatgttatggtacagtcgcctctcagtatccatggggcattggttccaggcctcccttaggatgccaaactccatggatactcaaaccccttctataaaatggtgtagtatttgcatatatcctagacacatcctcctgtatgctttaaatcatctctagattacttaaaatacctaatacaatgtaaatgctctgtaaatagttgttatactatattgtttagggaataatgacaaggaaaaaaaagcctgtacatgttcagcacaagtgaaaccatcctttttgcccccaaatattttcaatttgtatttggttgaatccatggatgcagaactcacggatacagagggccgactgtactttctttaaagtgttcaaaagtattactagcaaagaggaggaggagcaaagcatatatcagaagtaaaacaatttttcttgttgactgctttggtaaaaaacagtttgatggatagttttacatttcactggactagataaaaaatggtgctaatatttatgtagcttgatgctatagttgctttggtatcaaacttaatacctaacccatataagatccttattatataattttgtgatcagtaaaatgatattttaaagagtg

SEQ ID NO: 116307 - DNA, 5089 bp, Homo sapiens
  Payload ID: 2693
  Gene Symbol: CCSAP
  Gene Name: centriole, cilia and spindle-associated protein
  Uniprot ID: Q6IQ19
  ENST ID: ENST00000366687
  CDS Start-End: 53-865
gtaggctgcgggcagcgaggagcggctggcgctcgaggcggcggacggcaccatgtccccggggagcggggtgaagagcgagtacatgaagcgctaccaggagccgcgctgggaggagtacgggccgtgctaccgcgagctgctgcactaccgcctaggccgccggctgctggagcaggcgcacgcgccctggctctgggacgactggggcccggccggctcctcggaggactcggcgtcgtcagagtcgtcgggcgccgggggccccgcaccccggtgcgccccgccctcgcccccgccgcccgtagagccggcgacccaggaggaggcggaacggcgggcgcgcggggccccggaggagcaggacgcggaggccggggacgcggaggccgaggacgcggaggacgcggctctgccagcactgccagtgaaagatgtagaagataaacctgaacaacaaaccagaacaagagagactgacaaatcacccaccagtactgagcctcgacagcaaccaagtgccttatttgctagaggaaacaggaaagcggtcaaaagtccccaaagatcatcgagtaaaataaaagaaaacaagcatccatttgctctttatggctggggagaaaaacagaccgatacaggaagccagaagactcacaacgtctgtgcgtccgctcctgtgcacgagattcatgaatcagcattacgagccaagaacagaagacaggtggaaaaaaggaaactggttgctcaaaggcagcgagctcactctgtggatgtggagaagaacagaaagatgaaggcttcctcctcagagaacccgtggatgacagaatacatgaggtgctattcggcaagagcttaaagaaacacttgcgtggacagcctcttttaaaaagtgtaaatgactgaaaggaaaaacaaaacaaaaaccatcaaaagaaacggacacaggtttaagaaaccaactgattatgcaaggttttttttagggaatttgtaaaagattgttttattttgatgaatattggtcacctacctcggcagtagggcagacagttgaagccatagacatttggttatttatgaagataattccctaaatctttgatattcttataaggtttttgttttaaagcatcttaatcttttaagatactgacaccaaatgcctttaaatggcaacagatgcttacagttcagtattcttttcataagcttaggtagagcctattatcatcttgttctaaataactttccagattccatagctataagatcattccatcctacagcataagactcgttttccttatatgccgttttgtttgtgaaagaatatcaagtcaaaaatgagtgtcagcactactactgattccatgtataatgaaagtagaactttgctagttcctgaaaatttttaacttatttgtatttcagttcagcagcatctttatgtagattgtgatatttaagaattatctgggctgggcgagggtctctttttctctttcagtgatcatctaggcagttattatttaatagtttaatagctcaagtacattccaatagacgaagtgcacacaacacaatatgtgtgtacagtagtagtaaagtttcttttgagtagtcaaagactcactttttttattgcctttttttttttttttaaagaatacatactgtggattcagtcccttgtcacacttgaccttttggcatacacccactgtggacttttgcctcttctgtaatggctggcaatgacatttcaaacttacaatctggaattgcacttggtacattggcattgcttgttccactgggatggggaccagtgtgaagatgcctgttagatagactgcccacccctactttctctttttctttatagcacttaacaataacaaagtcttgatgatgtacagtattcaaactttaggttgaaatacgttactctttgattcctagccagtagatcttatctacactttaatgggagagaatggtggtgtgtgggtaggcacaaatttatgtaaatagtgctccttctctttagtatgtttgctttgggggtagaaaaatggttttaacaaacactggtttccatcaaatgaatgatgtcttctccatcctgtggagacaagaatctgctagaaggatatgtgctaagttccttataagagataatggtgctctgcctatgccagcttggcacccgaagatgtgtgagtggacgtgaggctgagtattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattgagatgtatatttcaaaagaggaaattttacatgttgtccaaaacagccttgctagtaactggtgaattttggtattaactattattaaagtctttaaacgacacaggtacctaaagatcaccttaatgtggcaatttgtgatggtgtagctagctgattgtgaaaactgttcctttaaagtcgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccagacttttctcttgtttagaaaacaaacttatatttaatgtacttactacttaaaactccagacagagatataatgtagaaggcaaatattggccaattttttcctctttttaagtggaagacaaatgaacgggatttttaaagtgcttttaaagtgcatgaatggttaataaatcagtatgaattgtaagccttcatcttacatccaagtccttagttggttagggtttcttttctttcttttttaaagagtgtcaattaccttttgaacctgtgaaaatttgatagttgttaacagtctgatggtcctaattctttcttttcattctagaaatgaatgtggttgtaatcatgttcctaattcttgggacaacctgcaagacagtgagacagtttaaaaattacctttcatgttgaaaaagtctgaaacagagaacccaatgatatttaaaataaatgctacataaaactctttttaaaattttgattttaacttaattaaaacaatgtcataaatatgctttttgattttgttactgcttttaatattaaagtaatagaatattgaagcaatattgtctagcactctgctggacattaagtccgcgggaggagaagtgaacaggaatcgattctttgtcttttaactgcccttagttaggagatgttaaaatacttggcacctctggttatatgtatgttatgtgtgttctcccccctaaaatttctaagcacatttattcacttttaaaatgaatctttaaaagattatagttagtagttatagttaatattctatttacttggaaaaatgtgaataaatggatcttcaaaagattcattttaaaaatgaataaatgtataataggctataggtgatcttacttgcgtattaggtaggaggcacatatttataccatttcatatgtaatatctttgtcattgtgtttcatcgaagatcaattgctagcaacttgaagggtatttatacttgggtcacttgaactcagctgactaaattgtaagaacgagagcaagcaagatggctgttattggaagccataacttccagaagataattctgcacaattcgtaagttaaaaaaaatctgtagggtcttccactatcctttttcaggttgataatgctgttctgggcacacactttgtaaatggaatgttatggtacagtcgcctctcagtatccatggggcattggttccaggcctcccttaggatgccaaactccatggatactcaaaccccttctataaaatggtgtagtatttgcatatatcctagacacatcctcctgtatgctttaaatcatctctagattacttaaaatacctaatacaatgtaaatgctctgtaaatagttgttatactatattgtttagggaataatgacaaggaaaaaaaagcctgtacatgttcagcacaagtgaaaccatcctttttgcccccaaatattttcaatttgtatttggttgaatccatggatgcagaactcacggatacagagggccgactgtactttctttaaagtgttcaaaagtattactagcaaagaggaggaggagcaaagcatatatcagaagtaaaacaatttttcttgttgactgctttggtaaaaaacagtttgatggatagttttacatttcactggactagataaaaaatggtgctaatatttatgtagcttgatgctatagttgctttggtatcaaacttaatacctaacccatataagatccttattatataattttgtgatcagtaaaatgatattttaaagagtgatcttaaaaatatgacctggtcattgcacaacgtttgcatttgaaatgaatttttgtactatagggtggatatggagttattcagtgcaagtgtgtgcttaatatcaaaccctatgcaaggagctatgtctagatttttggtccaaatttgcctccttcaagcctactagtgtgagatggaaaaaaatcgattgctcttttaatattatttccattttgaaattctcgacacttgaatgaaggcagtagaggcctctttttggatttctcttctaataacaaaactttatttagggaaggtttccctgtgctatcgtaagtttgttttgagcactgcattcactttaaaattctggaggaacaaaggctgggcacataatcacaaagcccaggccacacaataattcggggttgtattttctaagaactatgtattgtttttagcttatagttaatattgtatttacttggaaaaatgtgaataaagttaattaacattacaag

SEQ ID NO: 116308 - DNA, 7431 bp, Homo sapiens
  Payload ID: 2694
  Gene Symbol: CNTRL
  Gene Name: centriolin
  Uniprot ID: Q7Z7A1
  ENST ID: ENST00000238341
  CDS Start-End: 32-7009
gttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattgctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaataagtgcagcacaaactcgactatcagaactgcatgatgaaatagaaaaggcagaacaacaaattttgagagctactgaagaatttaaacaactggaagaagctatacaactaaaaaagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacattcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatc

SEQ ID NO: 116309 - DNA, 713 bp, Homo sapiens
  Payload ID: 2694
  Gene Symbol: CNTRL
  Gene Name: centriolin
  ENST ID: ENST00000373844
  CDS Start-End: 67-504
caatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgcttttctacagtaagcaagtatctctatgatcagaaaaaaagttaatatttaaatatctgtatttcaaaggccaaaaaattgttatataaatctcagtctgtatttcaaagtatttttaatttattttgatcaattttatataaaatgcttttagttgattcttttatgtagaagcaaatgctttggaaccagatctttgttaattaaatgtttttgttaaaa

SEQ ID NO: 116310 - DNA, 3372 bp, Homo sapiens
  Payload ID: 2694
  Gene Symbol: CNTRL
  Gene Name: centriolin
  ENST ID: ENST00000373847
  CDS Start-End: 158-3142
gcgaagttacagaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagtaagtaaggcctctgtagggctacaaggggtttgtgctggaagacagctctggggttccgagtcccttaggatctgctctagtgttgctggtgctttgtaggcttcagaaactacagaaagacatagagatggcagaacgcaatgaggatcaccacctgcaggtccttaaagaatctgaggtgcttcttcaggccaaaagagccgagctggaaaagctgaaaagccaggtatg

SEQ ID NO: 116311 - DNA, 5824 bp, Homo sapiens
  Payload ID: 2694
  Gene Symbol: CNTRL
  Gene Name: centriolin
  Uniprot ID: Q7Z7A1
  ENST ID: ENST00000373850
  CDS Start-End: 79-5400
gccggaaagcagaaggagattaaggacctgcaaatagccatagatagcctggattccaaagacccaaaacattcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 116312 - DNA, 7660 bp, Homo sapiens
  Payload ID: 2694
  Gene Symbol: CNTRL
  Gene Name: centriolin
  Uniprot ID: Q7Z7A1
  ENST ID: ENST00000373855
  CDS Start-End: 261-7238
cgaacttctcccgctctacctcagcctgcgggactgctcggctcggcttctaggcgagacaggggctccctgtgtttcccaggctgcagtgcagtggccagtcacaaggttgatcatagcacattgtagcctggagctcctgggatcaagcaatcctcctgcctcatcctctggagtaactgggactgcaagtatacataccgtgcctgacgaaatatcacaatatttggttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattgctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaataagtgcagcacaaactcgactatcagaactgcatgatgaaatagaaaaggcagaacaacaaattttgagagctactgaagaatttaaacaactggaagaagctatacaactaaaaaagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacattcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatc

SEQ ID NO: 116313 - DNA, 1917 bp, Homo sapiens
  Payload ID: 2694
  Gene Symbol: CNTRL
  Gene Name: centriolin
  ENST ID: ENST00000373865
  CDS Start-End: 237-1617
gggaaacgcctccgcgtcccttccaacagtaccggagagggagaggggcgtggctgagactagccccgaccacgcgcgcgcggcccctcggcaaccggcacaacacaacaaaatggctgccgcgccgctgggcccctgaggaaagagcccgaacttctcccgctctacctcagcctgcgggactgctcggctcggcttctaggcggttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattgctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaataagtgcagcacaaactcgactatcagaactgcatgatgaaatagaaaaggcagaacaacaaattttgagagctactgaagaatttaaacaactggaagaagctatacaactaaaaaagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacatgtgagtaaattaagaaattttgacttgttct

SEQ ID NO: 116314 - DNA, 1833 bp, Homo sapiens
  Payload ID: 2694
  Gene Symbol: CNTRL
  Gene Name: centriolin
  ENST ID: ENST00000431571
  CDS Start-End: 795-1833
gttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattg

SEQ ID NO: 116315 - DNA, 2418 bp, Homo sapiens
  Payload ID: 2694
  Gene Symbol: CNTRL
  Gene Name: centriolin
  Uniprot ID: Q7Z7A1
  ENST ID: ENST00000613863
  CDS Start-End: 549-1997
tagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaat

SEQ ID NO: 116316 - DNA, 3769 bp, Homo sapiens
  Payload ID: 2695
  Gene Symbol: CNTROB
  Gene Name: centrobin, centrosomal BRCA2 interacting protein
  Uniprot ID: Q8N137
  ENST ID: ENST00000380262
  CDS Start-End: 926-3703
gtggtctcgcgggcgggtgacgtcatcgaggcgagagaggcggagccgtggacagtgggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctccagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggtacaagcctgggaggaaggaggaaggattctccgggtggaagctggattatggggagtggagtgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctg

SEQ ID NO: 116317 - DNA, 2783 bp, Homo sapiens
  Payload ID: 2695
  Gene Symbol: CNTROB
  Gene Name: centrobin, centrosomal BRCA2 interacting protein
  Uniprot ID: Q8N137
  ENST ID: ENST00000565740
  CDS Start-End: 1-2715
atggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctccagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcggcaggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgta

SEQ ID NO: 116318 - DNA, 3705 bp, Homo sapiens
  Payload ID: 2695
  Gene Symbol: CNTROB
  Gene Name: centrobin, centrosomal BRCA2 interacting protein
  Uniprot ID: Q8N137
  ENST ID: ENST00000563694
  CDS Start-End: 926-3637
gtggtctcgcgggcgggtgacgtcatcgaggcgagagaggcggagccgtggacagtgggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctccagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgta

SEQ ID NO: 116319 - DNA, 561 bp, Homo sapiens
  Payload ID: 2695
  Gene Symbol: CNTROB
  Gene Name: centrobin, centrosomal BRCA2 interacting protein
  ENST ID: ENST00000576536
  CDS Start-End: 1-561
ccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttggattccctcccaggctgtccctcgccgccttgctacagcccc

SEQ ID NO: 116320 - DNA, 1209 bp, Homo sapiens
  Payload ID: 2695
  Gene Symbol: CNTROB
  Gene Name: centrobin, centrosomal BRCA2 interacting protein
  ENST ID: ENST00000571540
  CDS Start-End: 1-728
gggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagacctattctgttcttgggacccaagcttcttggctccagcccactcccccactagaggagctggaaagtttggtgctgtggtcataccaaagatgggcaacacccagactcctcacccttttccccagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacacta

SEQ ID NO: 116321 - DNA, 917 bp, Homo sapiens
  Payload ID: 2695
  Gene Symbol: CNTROB
  Gene Name: centrobin, centrosomal BRCA2 interacting protein
  ENST ID: ENST00000575408
  CDS Start-End: 320-917
gtcgggaagaggagcttcagcagcgctgttgtcccacactgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaa

SEQ ID NO: 116322 - DNA, 2960 bp, Homo sapiens
  Payload ID: 2695
  Gene Symbol: CNTROB
  Gene Name: centrobin, centrosomal BRCA2 interacting protein
  ENST ID: ENST00000571632
  CDS Start-End: 1-79
cacagccaccttgctcaaaatatcacagttggacaagtggattccaaaagctttcccagccctaacattctctacctgatttgctcagcacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcaggctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggtacaagcctgggaggaaggaggaaggattctccgggtggaagctggattatggggagtggagtgggtgtgttttacactgaattgaatcgttgtccttttctggggaggaaagtgaaggatgagaggtggatccacagatcttctctaactgccccacacttttcttttatctcctcctttctattgcttttttcttctaaacaaaaaaatcttttccccgggtctctctaccttcgtttttttcctctttacccctcagctcaaaactcagaatcctagacttttgactagctagtgtaactcgttatttacttccactaatgtctcctcccagttgatgcccaggtctatcgagtttgatcttattcttaagagatagaattggggagtagttcttccatccagtattgggtaaccggggggacggagatccccatcctcatacctttgatttgtgtagcaggactgatggccgaggggataatgtccccagaaggaacacagactcccgcttgggtgagatcccccggaaagaggtgagggaaagtcaggcagggaccaggggagaaaagggctctcactgaccagctccttcacctctgcacactcctggctggcccctccattccacccctgcattctgtagcatggcctttcctccctgcagactcatctggccctctccacgtgcatttcctcagtggggtggggaattgagaggatctgacgctgatttcttcctctctcttccctcaactctcagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgta

SEQ ID NO: 116323 - DNA, 784 bp, Homo sapiens
  Payload ID: 2695
  Gene Symbol: CNTROB
  Gene Name: centrobin, centrosomal BRCA2 interacting protein
  ENST ID: ENST00000576538
  CDS Start-End: 191-784
gcgcacgcgcggccaggcgctcgggatacagaagtgataaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaag

SEQ ID NO: 116324 - DNA, 752 bp, Homo sapiens
  Payload ID: 2695
  Gene Symbol: CNTROB
  Gene Name: centrobin, centrosomal BRCA2 interacting protein
  ENST ID: ENST00000570782
  CDS Start-End: 712-752
gggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacaaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggc

SEQ ID NO: 116325 - DNA, 695 bp, Homo sapiens
  Payload ID: 2695
  Gene Symbol: CNTROB
  Gene Name: centrobin, centrosomal BRCA2 interacting protein
  ENST ID: ENST00000570784
  CDS Start-End: 465-695
gagagattctagggaacaaggaagctcgctatggctttcttgccaggaggggtcgaagggaaagtacaagggagctggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcga

SEQ ID NO: 116326 - DNA, 1299 bp, Homo sapiens
  Payload ID: 2696
  Gene Symbol: CENPA
  Gene Name: centromere protein A
  Uniprot ID: P49450
  ENST ID: ENST00000233505
  CDS Start-End: 130-474
agcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaa

SEQ ID NO: 116327 - DNA, 1452 bp, Homo sapiens
  Payload ID: 2696
  Gene Symbol: CENPA
  Gene Name: centromere protein A
  Uniprot ID: P49450
  ENST ID: ENST00000335756
  CDS Start-End: 201-623
gttttaaaaaacgccggccgtgaagtgggcggagcgagcgatttgaacgcgagcggcgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcaagagaaatatgtgttaaattcactcgtggtgtggacttcaattggcaagcccaggccctattggccctacaagaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaatgga

SEQ ID NO: 116328 - DNA, 950 bp, Homo sapiens
  Payload ID: 2696
  Gene Symbol: CENPA
  Gene Name: centromere protein A
  ENST ID: ENST00000419525
  CDS Start-End: 96-356
tctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctgatcccttttcctatcctgggagattgcctctcatcacccaattactggtgatttccccatcaccagtaagagatccgccagttcctaagctcccaggagtcaacacctgctcctaattgggtcctaagattaagagccaggaaaaaataatggaaaggaagattcactggaactcatggagagcatcattgtcccttgaatctctcttctgttactccctactcctactcctccccttccccactccttcacaggcaagagaaatatgtgttaaattcactcgtggtgtggacttcaattggcaagcccaggccctattggccctacaagaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaag

SEQ ID NO: 116329 - DNA, 2840 bp, Homo sapiens
  Payload ID: 2697
  Gene Symbol: CENPB
  Gene Name: centromere protein B, 80kDa
  Uniprot ID: P07199
  ENST ID: ENST00000379751
  CDS Start-End: 208-2007
gcccgccgcccggcgacgcgcccgccggcgtccccggaggtgcccccggcccggccgggtcgtcgccccgccgccgcgcccgcgagccgctttgtctcgggcggggcgcgcgggagaggccgccaggtgccccccgccacgggcccgggccccccgccccggggcggcggcggcggcgccgggccccggggcggggggcgcgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagccagggatgggccctggaggttcccggccggagagtgcctctcccctctgccatccacgtcaggtctttggtggggggaccccaaagccattctgggaagggctccagaagaaggtccagcctaggccccctgcaaggctggcagcccccacccccaccccccaggccgccttgagaagcacagtttaactcactgcgggctcctgagcctgcttctgcctgctttccacctccccagtccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaacagccaa

SEQ ID NO: 116330 - DNA, 6940 bp, Homo sapiens
  Payload ID: 2698
  Gene Symbol: CENPC
  Gene Name: centromere protein C
  Uniprot ID: Q03188
  ENST ID: ENST00000273853
  CDS Start-End: 252-3083
atgtgtctccgggttcaaacccaggcacaggccaagcgttcttgtttgttgagggcggagccaatggcgggggagtgttgttagcgcgcgccttccggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactccttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttctgtagacttgtatttgataaacatttctaactcacatgttttttctgatttttcagtgactgtacataatagcttgtagcgatgtccatatttatgatattatttttataatttgacaagaatatgaaaatgaaatatagaacatttctgtgtcaaaagagacctgattaatatgtctactcattaaaaaacatcttttccaaatactaattttaaatcatttattattaaataatccaatgggagagaactgtggtaaaaggcatgtttgtattaatttcctagaactgctgtaacaaaataccacaaaatgagtgacttaaagcaacagaaatttattatctcagttctagaggctagaagtctgaaatcaaggtgttgtcaaggccgtgatgtctttgaaaacctgtaagggagagaatccttccttattcctaacttctggtggtttactggcaatttctggcattccttggcttgcaccggtagcatttcaatctacttgcattatcacatggtattctcaccttgtgtgtctgtgttggcatgacatctatttagtatattacatgtaaatgtttttccattatgctttttggttcatattttctgttggaggcagtgtccttcgccattgctttctgtatgtggcctcaactttccctttttaatatcaatcaatacatctaagctaaaaattctaatcaaggtttttggtatggttagcatataattctcattaactctgaagaaattgatgttttacggtaaaaatatttttaggccaactcccttttcaggtcttatttaaccattaaatacacacatttaaagcaactctggtgtaggacttaggaagaatgaagtgtgatggctctttttttatactttataattttctattgtgatttctcttttattgagtcatttttaattttttttttacttttatttctttgaatatatttgttatgaagtcttattgaaggcttgactaatcaagtatctgggcccatacagatttagttttcactgaatgctttttttcctttagtatatttcactttcatatgtttttacatgtctaataatttttggttgacagctggacattttaggtagcatattgtagcaactcaattttgttttatatctaagggatttgtattgttttaaatttagcattttgactggactcaaattgtggaatctatcttatatatgatgtgaagttattgctgtctgtgctcagtttttaagttctttatttcaatatttattcttgcttgctaggggtagttcctgtgtctgcatagcttagcagtcagccaatcatttggacaaaggttaagatcaaacacttgagtctataagccttccacccactgttggttgttctgtgtgggatgggggatgcattcattgtaggaggcagttcccaaattccccttggtttttacatttgccatgctctcttgagtctcccctgtgcatgcatcatttcagtttgccaaagatgtttggagagctcatgttacccttttctgcccttctgtttccaggaccttgttaaatgtctggctgctctgttgctcttcaagaactaggactgtaacctttggttagcaactacagatactccttgtccattcctaagtgatttttttacttttgacttacaaagttgtaggtttatacctctgctgtaaatcaagactcctcttacggcaaagttgctagtttttcagttagctacagccagacaaaactgtagtttttaccaatcaacctaggggtgggtgagacctcactcaaggaggccacagattccaacagttcttttccaaagctttagcaatattttttctttattttcttttttcttttcttttctttttttttttttttgaggcagagtttcactcttgttgcctgggctggagtgcgatggtgtgatctcggctcactgcaacctccacctcccgggttcaagcaattctcctgcgtcagcctcctgagtagctgggattacagttgcttgccaccacgcctggctagtttttgtgtttttagtagagacagattttcaccatgttggccagggctgtctcgaattcctgacctcagggtgatccacccacctcagcctcccaaagtgttgggattacaggtgtgagccactgtgcccagcttaagtgtagcctttctttgtctaaactgaaagcccatatggttcagcaaaggctctccattctgcttggtcagagccacgtctgatttttgccacctctgtactctgttcagctcataggcttctgtcatgtctcagaattttgctctgcacatttgcagcctactgttcagccaactgttcagccaacttctagggctataatggctgatacagtagtcacaagttgtagctatttaaaattaatttaaaatattgtttcttacttgcatttgccacatttcaagtgcttagtagcacatggtactggtggctaccacattagatgtcacagatacaagttgcagaaagttctgttcttgggcacctcgtgcagatttctggagctctttttcagtggagtttccacttctgtaccctgcatcacaattcagttttctcaacagccctaaattgtgatctttctgtgcccattaagaccactgttctttttgagcttaactctctgtgtccagttttggagagtgcccccaggcataaaactgggtgactatggagttaatttcatgtctttaaagaatcacagtcctgcctactttgtcaggcagccctcatgctcatgaagggtcttaaagaaagagacttctacccgggcatggtggctcatgcctgtaatcccaacactttgggaggctaagtcgggtggatcatgaggtcaggagttcgagaccagcctggctaacatggtgaaaccccgtctctactaaaatacaaaagttagccgggcatgatggcaggtgcctgtaatcccagctactcagaggctgaggcaggagaattgcttgaacctgggagatgatggttgcagtgagccaagatcacgcaactgcactccaggctgggcagccgagcaagactctgactcaaaaaaagaaaacaaaagaatcaccgtccttcacttttgtccaatgtctgcatagagttaccttttatctttttctattttaaagtttgttggaggagggcaaatttgatacccattaatccatcgtgggcatcacccatgagagtttttttaatgatttttctaatttttattgttggataggattccacagtttgttgtccatttacttaccacatggatgcatgtgtctttaatttcttccaatggttacttacatctatgtaactacaatgcagaaaacaggaatttggcaaggatacaatgcatgtgtatagttctatttcatcatatgtgtgaatttgtgtaactactgcaatcaacatagaactgtttcatcatcactaatttgttcttcatctctgtaatattgtcacttatatattgttgtagcaatggaataatatagtgtatgacctttggtttttctcactcagcataaagcccttaagatcatccaagcagttatacctatcaatagctcatttcttttttattgctaagtggtattctctagtatggatgactgtaccacaaataaagatgaagtgaacacttcctacaggtttttgtgtaaa

SEQ ID NO: 116331 - DNA, 2799 bp, Homo sapiens
  Payload ID: 2698
  Gene Symbol: CENPC
  Gene Name: centromere protein C
  ENST ID: ENST00000513216
  CDS Start-End: 1-2187
gaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactccttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaagtatgaacttatttctgaaagtaacttttagattttattttaaataggagtactttgagaagaagctctttgcaaaatatgaaatttacttccaaaaacttcagaaataataccatagagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttctgta

SEQ ID NO: 116332 - DNA, 933 bp, Homo sapiens
  Payload ID: 2698
  Gene Symbol: CENPC
  Gene Name: centromere protein C
  ENST ID: ENST00000515140
  CDS Start-End: 1-324
caatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaagtatgaacttatttctgaaagtaacttttagattttattttaaataggagtactttgagaagaagctctttgcaaaatatgaaatttacttccaaaaacttcagaaataataccatagagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaagacaatttatttcacttagacaacatgtatatagttgtttttgggcactatggaaatggaagccacagtggtcaaaatgaagtgtgatatgactgatggatgtcagaacagtttggtacatattttcctttcatttgatcattaggtaagtgtattagcattttgtggtggtttttttttgtttttgagaca

SEQ ID NO: 116333 - DNA, 3436 bp, Homo sapiens
  Payload ID: 2698
  Gene Symbol: CENPC
  Gene Name: centromere protein C
  Uniprot ID: Q03188
  ENST ID: ENST00000506882
  CDS Start-End: 129-1757
gagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactccttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagttgcctgaaatgctaagtactatgtggcagatgaatacataaacagatgggtaaataaattcttacagaacttggataaatgtgctagatctctgaaactatcaaaaaacacttatttaagagtcctgaaatagatgttggatttttgatcaagctgggagtcgaaaaagtggaggaatctttatatatcatatagtctaaactctcatctgatggaagaagaaactgaagtctgaagttaagaagaacaacttgacctgcccccagcctgcctgtcgtacgtgtgacactgttgcccttccatatatatgaagaaatgtatatggagtacttgccatggggcaggaatgaggtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagtttt

SEQ ID NO: 116334 - DNA, 8612 bp, Homo sapiens
  Payload ID: 2699
  Gene Symbol: CENPE
  Gene Name: centromere protein E, 312kDa
  Uniprot ID: Q02224
  ENST ID: ENST00000265148
  CDS Start-End: 91-8196
taaatttaaaggcggggcggcctgtgagccctgaagtgccggccgcggagggtcctggccattttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatgcagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgaggcccaaaacttatctatgcaaagtgtgagaatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttacggaaagcctgagagaaaagtgctctagaataaaagagcttttgaagagatactcagagatggatgatcattatgagtgcttgaatagattgtctcttgacttggagaaggaaattgaattccaaaaagagctttcaatgagagttaaagcaaacctctcacttccctatttacaaaccaaacacattgaaaaactttttactgcaaaccagagatgctccatggaattccacagaatcatgaagaaactgaagtatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaatcacc

SEQ ID NO: 116335 - DNA, 8241 bp, Homo sapiens
  Payload ID: 2699
  Gene Symbol: CENPE
  Gene Name: centromere protein E, 312kDa
  Uniprot ID: Q02224
  ENST ID: ENST00000380026
  CDS Start-End: 90-7832
aaatttaaaggcggggcggcctgtgagccctgaagtgccggccgcggagggtcctggccattttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagcaggaccgacagaaccaccaagtaaaacctgaaaaaaggttactaagtgatggacaacagcaccttacggaaagcctgagagaaaagtgctctagaataaaagagcttttgaagagatactcagagatggatgatcattatgagtgcttgaatagattgtctcttgacttggagaaggaaattgaattccaaaaagagctttcaatgagagttaaagcaaacctctcacttccctatttacaaaccaaacacattgaaaaactttttactgcaaaccagagatgctccatggaattccacagaatcatgaagaaactgaagtatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctg

SEQ ID NO: 116336 - DNA, 3468 bp, Homo sapiens
  Payload ID: 2699
  Gene Symbol: CENPE
  Gene Name: centromere protein E, 312kDa
  ENST ID: ENST00000503705
  CDS Start-End: 90-3468
aaatttaaaggcggggcggcctgtgagccctgaagtgccggccgcggagggtcctggccattttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatgcagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaag

SEQ ID NO: 116337 - DNA, 581 bp, Homo sapiens
  Payload ID: 2699
  Gene Symbol: CENPE
  Gene Name: centromere protein E, 312kDa
  ENST ID: ENST00000514974
  CDS Start-End: 31-581
attttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagaggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaagg

SEQ ID NO: 116338 - DNA, 8260 bp, Homo sapiens
  Payload ID: 2699
  Gene Symbol: CENPE
  Gene Name: centromere protein E, 312kDa
  ENST ID: ENST00000611174
  CDS Start-End: 91-8085
taaatttaaaggcggggcggcctgtgagccctgaagtgccggccgcggagggtcctggccattttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatgcagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgaggcccaaaactatctatgcaagtgtgagatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttacggaaagcctgagagaaaagtgctctagaataaaagagcttttgaagagatactcagagatggatgatcattatgagtgcttgaatagattgtctcttgacttggagaaggaaatggaattccacagaatcatgaagaaactgaagtatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttag

SEQ ID NO: 116339 - DNA, 10307 bp, Homo sapiens
  Payload ID: 2700
  Gene Symbol: CENPF
  Gene Name: centromere protein F, 350/400kDa
  Uniprot ID: P49454
  ENST ID: ENST00000366955
  CDS Start-End: 169-9513
agaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaaaatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtagaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaacggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaagaatgattcctaagtgt

SEQ ID NO: 116340 - DNA, 528 bp, Homo sapiens
  Payload ID: 2700
  Gene Symbol: CENPF
  Gene Name: centromere protein F, 350/400kDa
  ENST ID: ENST00000614578
  CDS Start-End: 1-528
ttgatgattaaaggaagaaaaggtaaggtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaaggaacaatga

SEQ ID NO: 116341 - DNA, 1389 bp, Homo sapiens
  Payload ID: 2701
  Gene Symbol: CENPH
  Gene Name: centromere protein H
  Uniprot ID: Q9H3R5
  ENST ID: ENST00000283006
  CDS Start-End: 88-831
tttcccggcgtccatttagtggcgggaaaagcgaccttttctgagcgcgtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacaggatgagactttcaactgcacttaaaaaaaacctggagaaaattagcagacagtctagtgtgctcatggataacatgaaacacctattagagctaaataaattaataatgaaatcacagcaggaatcttgggatttagaggaaaaactgcttgatattagaaagaagagattgcaattaaaacaagcttcagaaagtaagcttttagaaatacagactgaaaagaacaaacagaagattgatttggacagtatggaaaactcagagaggataaagatcatacgacaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgttttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagagacggggtttcaccgtgttgcccaggctgctctcagaactcctgagctcaggcagtccaccgcctcggcctaccgaagtgctaggattacagacgtaagccaccgagcctggtctagtttgcattttttttctatcagttttataagttaagaaataaaaggaattaatgtta

SEQ ID NO: 116342 - DNA, 437 bp, Homo sapiens
  Payload ID: 2701
  Gene Symbol: CENPH
  Gene Name: centromere protein H
  ENST ID: ENST00000513575
  CDS Start-End: 44-340
gcgcgtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggatgagactttcaactgcacttaaaaaaaacctggagaaaattagcagacagtctagtgtgctcatggataacatgaaacacctattagagctaaataaattaataatgaaatcacagcag

SEQ ID NO: 116343 - DNA, 692 bp, Homo sapiens
  Payload ID: 2701
  Gene Symbol: CENPH
  Gene Name: centromere protein H
  ENST ID: ENST00000502689
  CDS Start-End: 1-562
cgaggaccgcatgaccctgctcctcaggctgagagcacagacaaaacaacaactcttagaatataaatcaatggttgatgcaagtgaagaaaaaactccagaacaaattatgcaagaaaagcaaatcgaagcgatgagactttcaactgcacttaaaaaaaacctggagaaaattagcagacagtctagtgtgctcatggataacatgaaacacctattagagctaaataaattaataatgaaatcacagcaggaatcttgggatttagaggaaaaactgcttgatattagaaagaagagattgcaattaaaacaagcttcagaaagtaagcttttagaaatacagactgaaaagaacaaacagaagattgatttggacagtatggaaaactcagagaggataaagatcatacgacaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagt

SEQ ID NO: 116344 - DNA, 1305 bp, Homo sapiens
  Payload ID: 2701
  Gene Symbol: CENPH
  Gene Name: centromere protein H
  ENST ID: ENST00000515001
  CDS Start-End: 62-748
aaaagcgaccttttctgagcgcgtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacagtgtgctcatggataacatgaaacacctattagagctaaataaattaataatgaaatcacagcaggaatcttgggatttagaggaaaaactgcttgatattagaaagaagagattgcaattaaaacaagcttcagaaagtaagcttttagaaatacagactgaaaagaacaaacagaagattgatttggacagtatggaaaactcagagaggataaagatcatacgacaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgttttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagagacggggtttcaccgtgttgcccaggctgctctcagaactcctgagctcaggcagtccaccgcctcggcctaccgaagtgctaggattacagacgtaagccaccgagcctggtctagtttgcattttttttctatcagttttataagttaagaaataaaaggaattaatgtt

SEQ ID NO: 116345 - DNA, 2375 bp, Homo sapiens
  Payload ID: 2702
  Gene Symbol: CENPI
  Gene Name: centromere protein I
  Uniprot ID: Q92674
  ENST ID: ENST00000372926
  CDS Start-End: 278-1846
acagggtctcactgtgtcacccaggctggagtgcagtagtgcaatctctgctcactgcagccttcacctcctgggttcaagtgattctcctgcctcagcctcccgagtagctgggattacaggtgtgtgccaccatgcccaactagtttttgtattttttagcagagacggggtttcctcatattggccaggctggtctcaaactcctgtacgcctgacctcaagtcaggcccacctcggcctcccagagtgctgggattacagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtcccattaaagcttcacagaataaagataaaaccttggaaaaacacttgaaaactgtggaaaatgtggcttggaagaatgggttagcttcagaagaaattgatattctattaaatattgcactcagtggcaaatttggaaatgctgtaaacacacggatattgaagtgcatgatcccagcaacagtaatatcagaagattctgtggttaaggcagtctcctggctttgtgttggcaagtgttctggtagcaccaaggtacttttttatcgttggctggttgcaatgtttgacttcattgatcgtaaggagcaaattaacttgctctatggcttcttttttgcttcattgcaagatgatgcactgtgcccttatgtttgccatttgttatatttacttaccaaaaaagagaatgtcaaaccatttcgtgtgagaaaactgcttgatcttcaggccaaaatgggaatgcagcctcatctccaggctttgttgtcactgtataagttctttgctcctgctctgatttcagtatctttgcctgtaaggaagaagatatattttaagaattcagagaatctatggaagacggctctgcttgccgtgaagcaaagaaaccggggaccttctccagaacctctgaagttgatgttaggtccagctaatgttcgtcctctaaaaagaaagtggaattctctctcagttataccagtgctcaattccagtagctacactaaagaatgtggaaaaaaagagatgagtctttctgattgtctgaatagaagtggatcatttccactagaacaacttcaaagcttcccccaacttttacagaacatccattgcttagagctgccttctcagatgggctcagtgctaaacaactctctgctgcttcactacattaactgtgtcagagatgagccagtcttgctgaggttttattactggttgagtcaaacattacaagaagaatgtatttggtacaaggtgaataattatgaacatggaaaagaatttaccaacttcctggataccatcatcagggcagagtgcttcttacaagaggggttttattcctgtgaagcattcctgtataagagccttcctctctgggatggcctttgttgtcggtcacagttccttcagcttgtgagctggattccttttagtagcttctctgaggtgaaaccacttctttttgaccatctagcgcagctcttctttacatcaaccatttatttcaagtgtagtgtgcttcagagtctgaaagagctattgcagaattggctgttgtggctttctatggacattcacatgaaacctgttacaaacagtcctctgtgagttatctaacggtcttccacaagagacgatctgtatacaaatgtttgcatatgtttaatagtgtggcgtgaaacaatttttttcatgtaaatgcttagtagtacttttttggaagacttttttgtgacttttcactcttcttcccccacaatcctgaaaggaaggctaattctctaagttcctattgtgtaaatcagaaagcaacccttatctgctaaatgacttctttcaagagttaatataacaaaacactagagagatgagactagaatttgcaactttgacttccattcagtttaactcattttataaattatattcttatatttaaagccaattttcatgatggctagaaaaatctctaacgtaattttgcgtacaactttgtttttatgtttctgtgctgtattttggttatatgtgttaatttatcttaactttggagtttaaaataagagccctaaattgttaaatgtgtgctttaccttcaaagtaaaagtaaaagactaaatttcaaggaactgcataa

SEQ ID NO: 116346 - DNA, 3262 bp, Homo sapiens
  Payload ID: 2702
  Gene Symbol: CENPI
  Gene Name: centromere protein I
  Uniprot ID: Q92674
  ENST ID: ENST00000372927
  CDS Start-End: 278-2548
acagggtctcactgtgtcacccaggctggagtgcagtagtgcaatctctgctcactgcagccttcacctcctgggttcaagtgattctcctgcctcagcctcccgagtagctgggattacaggtgtgtgccaccatgcccaactagtttttgtattttttagcagagacggggtttcctcatattggccaggctggtctcaaactcctgtacgcctgacctcaagtcaggcccacctcggcctcccagagtgctgggattacagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtcccattaaagcttcacagaataaagataaaaccttggaaaaacacttgaaaactgtggaaaatgtggcttggaagaatgggttagcttcagaagaaattgatattctattaaatattgcactcagtggcaaatttggaaatgctgtaaacacacggatattgaagtgcatgatcccagcaacagtaatatcagaagattctgtggttaaggcagtctcctggctttgtgttggcaagtgttctggtagcaccaaggtacttttttatcgttggctggttgcaatgtttgacttcattgatcgtaaggagcaaattaacttgctctatggcttcttttttgcttcattgcaagatgatgcactgtgcccttatgtttgccatttgttatatttacttaccaaaaaagagaatgtcaaaccatttcgtgtgagaaaactgcttgatcttcaggccaaaatgggaatgcagcctcatctccaggctttgttgtcactgtataagttctttgctcctgctctgatttcagtatctttgcctgtaaggaagaagatatattttaagaattcagagaatctatggaagacggctctgcttgccgtgaagcaaagaaaccggggaccttctccagaacctctgaagttgatgttaggtccagctaatgttcgtcctctaaaaagaaagtggaattctctctcagttataccagtgctcaattccagtagctacactaaagaatgtggaaaaaaagagatgagtctttctgattgtctgaatagaagtggatcatttccactagaacaacttcaaagcttcccccaacttttacagaacatccattgcttagagctgccttctcagatgggctcagtgctaaacaactctctgctgcttcactacattaactgtgtcagagatgagccagtcttgctgaggttttattactggttgagtcaaacattacaagaagaatgtatttggtacaaggtgaataattatgaacatggaaaagaatttaccaacttcctggataccatcatcagggcagagtgcttcttacaagaggggttttattcctgtgaagcattcctgtataagagccttcctctctgggatggcctttgttgtcggtcacagttccttcagcttgtgagctggattccttttagtagcttctctgaggtgaaaccacttctttttgaccatctagcgcagctcttctttacatcaaccatttatttcaagtgtagtgtgcttcagagtctgaaagagctattgcagaattggctgttgtggctttctatggacattcacatgaaacctgttacaaacagtcctctagagacaactttgggtggatccatgaactctgtgtctaaactgatccactatgtagggtggctatccactactgcaatgcgcttggagagcaacaatactttcttgctgcactttattttggatttctatgagaaggtgtgtgacatatatataaattataaccttccattagtggtattgtttcctcctgggatcttctattctgcactcctcagcctggataccagcatcctgaaccagctgtgttttattatgcacagatatcgtaaaaatttgactgccgcaaagaaaaatgagttggtacaaaagacaaaatcagagttcaatttcagcagcaagacttatcaagaatttaatcactatttgacatcaatggttggttgcctgtggacgtccaaaccctttgggaaaggaatatatattgaccctgaaatcctagaaaaaactggagtggctgaatataaaaacagtttaaatgtagtccatcatccttctttcttgagttacgctgtttcctttttgctacaggaaagcccagaagaaaggacagtaaatgtgagctctattcggggaaagaaatggagctggtatttggactatttattttcacaggggttacaaggcttgaaactttttataagaagtagtgttcatcattcttccattcccagagcagagggcataaactgcaacaatcaatattaaatgaatgttgacataaactgaacacactggactaaactcactcctcattgctagagcaaagtggctcatcttgagttcccattttcatttcactgacagactgccatcctcaaggagtactcagactggccttctgttcatggcttaggagagccttggtgtgcctaactgatttttcaaaatttagatttttttagcctaccagtgaaaaatgaccccttcatcatcaggctctgcgttctaccaaattgtatgtaaaaagacacatctgttttgtggtaggattttttcacatttttgggtactatgagctgcattgatggaagacagcaggcaatatgtggtgacagttaactcacagacataaacatgcaaaatactttgctgtctctggggatattgccatttttcttactgtgagcaacagcaccaacaccaagttaacaggatgcaacatgtgtatgactctaaaagccctaagtagttggtaacttcctgggccttcaatcatagcaatttgatgagggaaggaaggggagaggatttgttgggtaatcaagacattcccgtatatgtctgatttcatggaactgctctattttgtttgtgtgtattgtatatgtatatgtgtatgtgtgcgtgtatgtgtgtgtctgtagcttcagtttttaagtgtaaggactaaataaactaactgaaattttactttcagaa

SEQ ID NO: 116347 - DNA, 622 bp, Homo sapiens
  Payload ID: 2702
  Gene Symbol: CENPI
  Gene Name: centromere protein I
  ENST ID: ENST00000403304
  CDS Start-End: 398-622
ggcctgtgcggctgcaggtagagtgtcttaggaacctaggaaataactcggaacctgtaacgtcccactggtttggacatattcctctcctgatctggcctcatctgttccagggaggtgggattgaacaaagtcttgctctgtcacccaggctggagtgcagtggcgcaatcacggctctctgcagcctcgacccccggggctcaagctattctcctgcctcaccctcctgagtagataggactacaggcacgtgcggctatgcctagctaattttttaaatcttaagtagagacattgtctcactgtgttgcccagactggtcttgaactcctaggttgaagggatcttccagcctctgcctcccgaagtgctgtattacagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaa

SEQ ID NO: 116348 - DNA, 2314 bp, Homo sapiens
  Payload ID: 2702
  Gene Symbol: CENPI
  Gene Name: centromere protein I
  Uniprot ID: Q92674
  ENST ID: ENST00000423383
  CDS Start-End: 24-2294
ttctgtgtagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtcccattaaagcttcacagaataaagataaaaccttggaaaaacacttgaaaactgtggaaaatgtggcttggaagaatgggttagcttcagaagaaattgatattctattaaatattgcactcagtggcaaatttggaaatgctgtaaacacacggatattgaagtgcatgatcccagcaacagtaatatcagaagattctgtggttaaggcagtctcctggctttgtgttggcaagtgttctggtagcaccaaggtacttttttatcgttggctggttgcaatgtttgacttcattgatcgtaaggagcaaattaacttgctctatggcttcttttttgcttcattgcaagatgatgcactgtgcccttatgtttgccatttgttatatttacttaccaaaaaagagaatgtcaaaccatttcgtgtgagaaaactgcttgatcttcaggccaaaatgggaatgcagcctcatctccaggctttgttgtcactgtataagttctttgctcctgctctgatttcagtatctttgcctgtaaggaagaagatatattttaagaattcagagaatctatggaagacggctctgcttgccgtgaagcaaagaaaccggggaccttctccagaacctctgaagttgatgttaggtccagctaatgttcgtcctctaaaaagaaagtggaattctctctcagttataccagtgctcaattccagtagctacactaaagaatgtggaaaaaaagagatgagtctttctgattgtctgaatagaagtggatcatttccactagaacaacttcaaagcttcccccaacttttacagaacatccattgcttagagctgccttctcagatgggctcagtgctaaacaactctctgctgcttcactacattaactgtgtcagagatgagccagtcttgctgaggttttattactggttgagtcaaacattacaagaagaatgtatttggtacaaggtgaataattatgaacatggaaaagaatttaccaacttcctggataccatcatcagggcagagtgcttcttacaagaggggttttattcctgtgaagcattcctgtataagagccttcctctctgggatggcctttgttgtcggtcacagttccttcagcttgtgagctggattccttttagtagcttctctgaggtgaaaccacttctttttgaccatctagcgcagctcttctttacatcaaccatttatttcaagtgtagtgtgcttcagagtctgaaagagctattgcagaattggctgttgtggctttctatggacattcacatgaaacctgttacaaacagtcctctagagacaactttgggtggatccatgaactctgtgtctaaactgatccactatgtagggtggctatccactactgcaatgcgcttggagagcaacaatactttcttgctgcactttattttggatttctatgagaaggtgtgtgacatatatataaattataaccttccattagtggtattgtttcctcctgggatcttctattctgcactcctcagcctggataccagcatcctgaaccagctgtgttttattatgcacagatatcgtaaaaatttgactgccgcaaagaaaaatgagttggtacaaaagacaaaatcagagttcaatttcagcagcaagacttatcaagaatttaatcactatttgacatcaatggttggttgcctgtggacgtccaaaccctttgggaaaggaatatatattgaccctgaaatcctagaaaaaactggagtggctgaatataaaaacagtttaaatgtagtccatcatccttctttcttgagttacgctgtttcctttttgctacaggaaagcccagaagaaaggacagtaaatgtgagctctattcggggaaagaaatggagctggtatttggactatttattttcacaggggttacaaggcttgaaactttttataagaagtagtgttcatcattcttccattcccagagcagagggcataaactgcaacaatcaatattaaatgaatgttgacataaactg

SEQ ID NO: 116349 - DNA, 390 bp, Homo sapiens
  Payload ID: 2702
  Gene Symbol: CENPI
  Gene Name: centromere protein I
  ENST ID: ENST00000435570
  CDS Start-End: 256-390
ctgtgcggctgcaggaacctaggaaataactcggaacctgtaacgtcccactggtttggacatattcctctcctgatctggcctcatctgttccagggaggtgggattgagcctagtgcaggctacagtcaaacctcttctggacttctgcgacagccttttatttggtttcttgccgctccttgacctctaacattctcgtctctgcactgcagctaacatgatcgtcaaacacaaatcagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacat

SEQ ID NO: 116350 - DNA, 4347 bp, Homo sapiens
  Payload ID: 2703
  Gene Symbol: CENPJ
  Gene Name: centromere protein J
  Uniprot ID: Q9HC77
  ENST ID: ENST00000381884
  CDS Start-End: 187-4203
aggacctcgggacgggggcggggctccgacagaggcggcgattgtggcggcccatttgtaaatgctgcggagattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacagactttaaaacagcaaatagcagatttacgggaagatttgaaaagaaaggaaaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattagattctaaaataaaagtttaccctgtggcatcttca

SEQ ID NO: 116351 - DNA, 691 bp, Homo sapiens
  Payload ID: 2703
  Gene Symbol: CENPJ
  Gene Name: centromere protein J
  ENST ID: ENST00000418179
  CDS Start-End: 1-589
gtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacagactttaaaacagcaaatagcagatttacgggaagatttgaaaagaaaggaaaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggtaagaggctgcatgatctttttataaaacatttcagaatgtaaggaataaacaatttatacccaacttaataaaacatttcttaataaatgtttttgaacatttgaatgaatttgaattaataaatgtaattgaagctcctgtgc

SEQ ID NO: 116352 - DNA, 4299 bp, Homo sapiens
  Payload ID: 2703
  Gene Symbol: CENPJ
  Gene Name: centromere protein J
  ENST ID: ENST00000545981
  CDS Start-End: 117-3527
agattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacagactttaaaacagcaaatagcagatttacgggaagatttgaaaagaaaggaaaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggcacagcacagccgcctcacacgcccagcagcttgttggctgaccacctgcctccgctctcctccttcaggccattctcccgtaacatccagctctgttacactttttaacatggaggtcagattctggcacttgctcgagacccttccaaggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtga

SEQ ID NO: 116353 - DNA, 5020 bp, Homo sapiens
  Payload ID: 2703
  Gene Symbol: CENPJ
  Gene Name: centromere protein J
  Uniprot ID: Q9HC77
  ENST ID: ENST00000616936
  CDS Start-End: 196-3456
acttcccacaggacctcgggacgggggcggggctccgacagaggcggcgattgtggcggcccatttgtaaatgctgcggagattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacagactttaaaacagcaaatagcagatttacgggaagatttgaaaagaaaggaaaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattagattctaaaataaaagtttaccctgtggcatcttcatttttatattctttgaaatgcaatgatagctctcatttataattcactaccctgtctttcaatagactaaggaaagcattttgactgtttagaaattgtgtacaggtttttacagtaagtgggtgtgtttattggttagaaatggctataaaaaaaaaccaagaagtacaggaagtacatcacctagatgtcccacagacacatcagccgtagagcactggacttgtacagaaggtgtactcaaggagtaaacacgtgtctctgtagccaaaatattactatgttcagttagtaccaaaattagaccatttgatcttctacagaggatcattaattattataacagaatgggaagttacaacagtggatgaatataaataggtcacacacaacaggtagtaatcatggtgaagagaaagcagttataacaaggctgactttgtaatgtaatgtctcaaaatgggatacttgagagtggaggggggcatgaacgatgactagccagtgttaacccatggaccacagctaccctgatgttaccacagtgagattactgtagcctcatggaagcaagatgtccctgaaggatgggcaagtcacttacttacttacttgtaaatttatataataaataattacagattggtctagatagaccttacctgtcacatatactatgaatcaggttttgttaatgaaatctatcaattccaggtgacttaactgaatatgaaaaataaaactttttg

SEQ ID NO: 116354 - DNA, 1576 bp, Homo sapiens
  Payload ID: 2704
  Gene Symbol: CENPK
  Gene Name: centromere protein K
  Uniprot ID: Q9BS16
  ENST ID: ENST00000242872
  CDS Start-End: 59-868
taaatattttttgctttagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctct

SEQ ID NO: 116355 - DNA, 1734 bp, Homo sapiens
  Payload ID: 2704
  Gene Symbol: CENPK
  Gene Name: centromere protein K
  Uniprot ID: Q9BS16
  ENST ID: ENST00000396679
  CDS Start-End: 216-1025
cgcgcagaagtccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 116356 - DNA, 1586 bp, Homo sapiens
  Payload ID: 2704
  Gene Symbol: CENPK
  Gene Name: centromere protein K
  ENST ID: ENST00000508421
  CDS Start-End: 212-931
gcgacctggagtttgtgacgctgtgatggtctagaggctggagattcaagatctgggtgccatcattttctggttctgttgatgaccctcttccaggttacatacagcttacatcttgcatcctcaagcggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacat

SEQ ID NO: 116357 - DNA, 653 bp, Homo sapiens
  Payload ID: 2704
  Gene Symbol: CENPK
  Gene Name: centromere protein K
  ENST ID: ENST00000515497
  CDS Start-End: 125-653
gcagaagtccggggctggcaagcgcttcctgcgcagcgcctaggcgacctggagtttgtgacgctgtgatggtctagaggctggagattcaagatctgggtgccatcattttctggttctgttgatgaccctcttccaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggaga

SEQ ID NO: 116358 - DNA, 1697 bp, Homo sapiens
  Payload ID: 2704
  Gene Symbol: CENPK
  Gene Name: centromere protein K
  Uniprot ID: Q9BS16
  ENST ID: ENST00000514814
  CDS Start-End: 179-988
gcagaagtccggggctggcaagcgcttcctgcgcagcgcctaggcgacctggagtttgtgacgctgtgatggtctagaggctggagattcaagatctgggtgccatcattttctggttctgttgatgaccctcttccagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 116359 - DNA, 834 bp, Homo sapiens
  Payload ID: 2704
  Gene Symbol: CENPK
  Gene Name: centromere protein K
  ENST ID: ENST00000505960
  CDS Start-End: 113-433
tgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaaggtctcatcgtgttgtccaggctggagtacagtggcacaatcatggctcattgcagccccgatctcccgggttcaagtgatcctcctacctcagcctcctgagtagctaggactacaagtgtgtgccaccatgcttgcaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgtt

SEQ ID NO: 116360 - DNA, 725 bp, Homo sapiens
  Payload ID: 2704
  Gene Symbol: CENPK
  Gene Name: centromere protein K
  ENST ID: ENST00000510768
  CDS Start-End: 138-491
aggcgacctggagtttgtgacgctgtgatggtctagaggctggagattcaagatctgggtgccatcattttctggttctgttgatgaccctcttccagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagattctgcagatgatgattctctcctacaaaccagttgggtgtcctcttaattcacttcagttctgacataatctacttggagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatat

SEQ ID NO: 116361 - DNA, 474 bp, Homo sapiens
  Payload ID: 2704
  Gene Symbol: CENPK
  Gene Name: centromere protein K
  ENST ID: ENST00000509397
  CDS Start-End: 1-73
tcgtgttgtccaggctggagtacagtggcacaatcatggctcattgcagccccgatctcccgggttcaagtgatcctcctacctcagcctcctgagtagctaggactacaagtgtgtgccaccatgcttgcaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgtt

SEQ ID NO: 116362 - DNA, 760 bp, Homo sapiens
  Payload ID: 2704
  Gene Symbol: CENPK
  Gene Name: centromere protein K
  ENST ID: ENST00000502997
  CDS Start-End: 365-760
ttcatgtcttcttactcagttgtcaatttctcagtaaccttatatgaccaccttatttaaaattatattgtccttgccctagcatttcctatgtttcttccttgtcttttctccatggcacttataaatcatttgatatactacagtatatatatgttttattttttattttattgtctgttttccttacttagaataaggttcacggtaggagggatttttgtctattttgttcattgctatattcttaccccctagatgagtatctggcaggtaataagtgttcaaccaatactgctgaatgaataaatattttttgctttagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacag

SEQ ID NO: 116363 - DNA, 1040 bp, Homo sapiens
  Payload ID: 2704
  Gene Symbol: CENPK
  Gene Name: centromere protein K
  ENST ID: ENST00000510693
  CDS Start-End: 280-900
gcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgct

SEQ ID NO: 116364 - DNA, 1124 bp, Homo sapiens
  Payload ID: 2704
  Gene Symbol: CENPK
  Gene Name: centromere protein K
  ENST ID: ENST00000510354
  CDS Start-End: 108-428
gtctagaggctggagattcaagatctgggtgccatcattttctggttctgttgatgaccctcttccagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaaggtctcatcgtgttgtccaggctggagtacagtggcacaatcatggctcattgcagccccgatctcccgggttcaagtgatcctcctacctcagcctcctgagtagctaggactacaagtgtgtgccaccatgcttggttagtggttggtttttgtatttttttgtagagacggggtttcaccatgttacccaggctggtcttgaactcctgggctcaagggatcctcctgccttggcctctcaaagtgcctggattactggcgtgccagtgatttgtttcttaatgaatgcaatttacctagtggaagagaaaagttataatttattttagatacttacacaaaagggacacatagtttgtatgtcttctgtcttgtccagctggtgccaactatgtttttgtcttcagttaggaagtagaagacagcataaaaatttataattgtgatactccactagtacatcttttttttttaaatgtgagagcttaagtttctctatgcaatatacatctatacaggcacatctcattttattgtgcttcactttattgcactttgcagacactctatgtttaacaaattcagtttgtggcgagcctgtgtcacattttggtaatctcacagtattttagacttttaagtcattattacatctggttgggggatctgtgatcagtggtctttgatcttactattttaattgttttgaggaaccacaagctgcacctgtgtaagacagtaaatttaaccaataaatgttgtgtgtattctga

SEQ ID NO: 116365 - DNA, 1847 bp, Homo sapiens
  Payload ID: 2705
  Gene Symbol: CENPL
  Gene Name: centromere protein L
  Uniprot ID: Q8N0S6
  ENST ID: ENST00000345664
  CDS Start-End: 215-1249
tttgtgtctcttgtgaacccacttgtggagcgagagggaatttgggagggccaggggttagtctggcctctgtcttagctgtcattttggcggttttttttttttttcttcaggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtccagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttccccaccatgcctttggagttgccaagatggaagccaagaaggatctagaagaacaaagaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaa

SEQ ID NO: 116366 - DNA, 2357 bp, Homo sapiens
  Payload ID: 2705
  Gene Symbol: CENPL
  Gene Name: centromere protein L
  Uniprot ID: Q8N0S6
  ENST ID: ENST00000356198
  CDS Start-End: 287-1459
ggtctctgacaggctcagctggagagggacgggttgggacgcactgtccttttgcccttccccctccgcgagcagaagctgactccgcaggagcgagggtcgcagagctgggtgagcggaaatgtccctcccagagtgaagtcgcagggcccgccccgcgtctgagggagcggaggtcttcctgggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtccagggtctcattttgtcacccaggctggagtacagtggcacgatcttggttgactgcaacctctgtctcctgggctcaagtgatccttccaccttagccttccaagtagctgggactgcaggtgcatgccaccacactcggattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttccccaccatgcctttggagttgccaagatggaagccaagaaggatctagaagaacaaagaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaatacagcgtttattatgtttaaactcttaggattcaaatgagatgtatctaatggatatttctgatttgggtctttaaaacctttaatctcttttaagcattttagacttgcattcagaaagaattctgtcttctaaagacattttcctagcatttcactgcggagaactggcaatcaaaatcccctcaaaagggaactaaagattaatatacacatttttttagtcattaatatgcttctgttttaaatacagttcaactcctgttgcaatgttgaattaaatgtttattttaaaatgaa

SEQ ID NO: 116367 - DNA, 1771 bp, Homo sapiens
  Payload ID: 2705
  Gene Symbol: CENPL
  Gene Name: centromere protein L
  Uniprot ID: Q8N0S6
  ENST ID: ENST00000367710
  CDS Start-End: 139-1173
gcccgccccgcgtctgagggagcggaggtcttcctgggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtccagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttccccaccatgcctttggagttgccaagatggaagccaagaaggatctagaagaacaaagaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaa

SEQ ID NO: 116368 - DNA, 966 bp, Homo sapiens
  Payload ID: 2706
  Gene Symbol: CENPM
  Gene Name: centromere protein M
  Uniprot ID: Q9NSP4
  ENST ID: ENST00000215980
  CDS Start-End: 89-631
cccccaggccgcgctctaggggctggactcagggcggtttgaaagatcggcgcgcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcacca

SEQ ID NO: 116369 - DNA, 688 bp, Homo sapiens
  Payload ID: 2706
  Gene Symbol: CENPM
  Gene Name: centromere protein M
  ENST ID: ENST00000402420
  CDS Start-End: 279-656
ggcggtgggagcgagggtcgggtagtagagagtgcggtgcccacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcagctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacaggatcagagaagcaaggacttctgctttctccgttgtaaagttttgttctctggtttgttttctcaccctggcctggccaccccagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatgg

SEQ ID NO: 116370 - DNA, 1002 bp, Homo sapiens
  Payload ID: 2706
  Gene Symbol: CENPM
  Gene Name: centromere protein M
  ENST ID: ENST00000402338
  CDS Start-End: 243-683
gtgcccacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcagctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatca

SEQ ID NO: 116371 - DNA, 818 bp, Homo sapiens
  Payload ID: 2706
  Gene Symbol: CENPM
  Gene Name: centromere protein M
  Uniprot ID: Q9NSP4
  ENST ID: ENST00000407253
  CDS Start-End: 61-384
tcagggcggtttgaaagatcggcgcgcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaa

SEQ ID NO: 116372 - DNA, 905 bp, Homo sapiens
  Payload ID: 2706
  Gene Symbol: CENPM
  Gene Name: centromere protein M
  ENST ID: ENST00000404067
  CDS Start-End: 238-459
cacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcagctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatca

SEQ ID NO: 116373 - DNA, 541 bp, Homo sapiens
  Payload ID: 2706
  Gene Symbol: CENPM
  Gene Name: centromere protein M
  Uniprot ID: Q9NSP4
  ENST ID: ENST00000472374
  CDS Start-End: 46-222
aggcaggccacggagatacctcgtggaaggaggaacagcaagtgcatgggccgagtgtgggacttgcctggtgtgctcaaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatca

SEQ ID NO: 116374 - DNA, 1398 bp, Homo sapiens
  Payload ID: 2707
  Gene Symbol: CENPN
  Gene Name: centromere protein N
  Uniprot ID: Q96H22
  ENST ID: ENST00000299572
  CDS Start-End: 737-1351
cacctcgctcgcagcctccccagcgcagcagcccggctgtgggcctgcggcagccgggtcttcctggtccccacctcctggggccgacgggcggcaggaaggggctcggcgggacgcgccatcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctcctcgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggaagtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggagttagaagctactgggaaaatctacctccgacaagaggagatcattttagatattaccgaaatgaagaaagcttgcaattagtgaacatgaaaggaaaataaaaattcctcacagtcatctttttataa

SEQ ID NO: 116375 - DNA, 2481 bp, Homo sapiens
  Payload ID: 2707
  Gene Symbol: CENPN
  Gene Name: centromere protein N
  Uniprot ID: Q96H22
  ENST ID: ENST00000305850
  CDS Start-End: 791-1810
gagcgacgcccacggcctgtctcggccaccagcgtgttccagcgagcgcccagccacctcgctcgcagcctccccagcgcagcagcccggctgtgggcctgcggcagccgggtcttcctggtccccacctcctggggccgacgggcggcaggaaggggctcggcgggacgcgccatcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctcctcgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggaagtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtatctggactctcttaaggctattgtttttaaacagtataatcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaataagacgtgcgtggtttcttaagcacagctcctccttcttgatattgcacatgcacttcagttcatggctagctgtatagcttccgtctgtaaacttgtattttcaagaatccttggtattgaatttttagaaatgctcacataattgttgggactgattcattcctccacgatatgcctcctctctctgatatcctgctaactgtagccgttgtggcatttgagatgacaggacatatatatatatggccccacacttgaccttgagtgcctgaatgctctgaaatcaagcatatggcacagcgctcaagacttttgggtttgtgtccttttttctatggctgtctcttctcaattctggagaggtctggttccagtggctggtttccagggattgattcttaagctctggatcacagagagaagcaacaaggaactatactcaactcaaaactttttaggagaatcatgaaattggtctattcaaaggatggagttgagtccattctgttattgttgcaagaggttgcatatttggtgagtcagttatataaaatagtgttcttattgtaaatatgatacttctcataatctattttatcatgtgtataacattcaaactgacaaatatattgacttatgaataaaggtgtcaaaaaactggcacatcagtt

SEQ ID NO: 116376 - DNA, 1556 bp, Homo sapiens
  Payload ID: 2707
  Gene Symbol: CENPN
  Gene Name: centromere protein N
  Uniprot ID: Q96H22
  ENST ID: ENST00000393335
  CDS Start-End: 75-1136
ggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggaagtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtatctggactctcttaaggctattgtttttaaacagtataatcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcggcacttgtttgcaggatccaaaagctgctctgctattctggaagccacagtcaagggacccaggacccgagcagctggcagaaggacttgtaccttctgtttgtcccattgtatccaagatgttaaaatcatgatgtcacaacatttagacatttaaatggttaatcaaatgtatgtctctcctgatatacagctaactgctatagactaatgcaggcctccttgttaaaatggaccctttgttactcaaatttgaccaatcttggaagcttggatgtgcactgacttgacaaccactttttgtgggacataacactctagacacaggtgcttctagctctaaggggaacagataactaatctgtggccaaccaaccaatgattaatcagctatgctgcctcggatcttgatcaaaaaaggaaaatgtgaaaagtgatacacaaaatggcatcactttggttcagagctctaaaatggagttgggaagccattctaagaaggactgcctgcacaatctgcaacttgcaaaacacaaaaacaaaaaa

SEQ ID NO: 116377 - DNA, 971 bp, Homo sapiens
  Payload ID: 2707
  Gene Symbol: CENPN
  Gene Name: centromere protein N
  Uniprot ID: Q96H22
  ENST ID: ENST00000428963
  CDS Start-End: 45-962
tcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggaagtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaataagacgtgcgt

SEQ ID NO: 116378 - DNA, 1699 bp, Homo sapiens
  Payload ID: 2707
  Gene Symbol: CENPN
  Gene Name: centromere protein N
  Uniprot ID: Q96H22
  ENST ID: ENST00000439957
  CDS Start-End: 82-1041
aattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttgtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtatctggactctcttaaggctattgtttttaaacagtataatcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaataagacgtgcgtggtttcttaagcacagctcctccttcttgatattgcacatgcacttcagttcatggctagctgtatagcttccgtctgtaaacttgtattttcaagaatccttggtattgaatttttagaaatgctcacataattgttgggactgattcattcctccacgatatgcctcctctctctgatatcctgctaactgtagccgttgtggcatttgagatgacaggacatatatatatatggccccacacttgaccttgagtgcctgaatgctctgaaatcaagcatatggcacagcgctcaagacttttgggtttgtgtccttttttctatggctgtctcttctcaattctggagaggtctggttccagtggctggtttccagggattgattcttaagctctggatcacagagagaagcaacaaggaactatactcaactcaaaactttttaggagaatcatgaaattggtctattcaaaggatggagttgagtccattctgttattgttgcaagaggttgcatatttggtgagtcagttatataaaatagtgttcttattgtaaatatgatacttctcataatctattttatcatgtgtataacattcaaactgacaaatatattgacttatgaataaaggtgtcaaaaaac

SEQ ID NO: 116379 - DNA, 730 bp, Homo sapiens
  Payload ID: 2707
  Gene Symbol: CENPN
  Gene Name: centromere protein N
  ENST ID: ENST00000564669
  CDS Start-End: 200-730
gactgcaggagatgtgggccggtaagagagccccgggcggcactggatcgggccccggagggtgtggggccttgaggaagccagatcccaggcctcgggggtggctttttcgcaattgtcgcacgttgtgaggcgcaggattggcgctgggtctcgggctcggggcgaggaactacggttcgggccgagtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggaagtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcag

SEQ ID NO: 116380 - DNA, 591 bp, Homo sapiens
  Payload ID: 2707
  Gene Symbol: CENPN
  Gene Name: centromere protein N
  ENST ID: ENST00000568445
  CDS Start-End: 26-256
aggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttgtaagtgtcagtgatttgtatttatacttaaccaatcagtttattagaggcaattttgtttctttctttgtgagacagggtctccctctgtcgcccaggctggagtgcagtaacgccatctcagctcaccgcgacctctgcctcctggattcaagtgattctccaacctcagcctcccgagtagctgggactatagcagtgcaccaccatatatgcaatttcatcagcaccagaaagtttgggaagtttttcagatgagtaaaggaccaggtgaagatgttgacctttttgatatgaaacaatttaaaaattcgttcaagaaaattcttcagagagcattaaaaaatgt

SEQ ID NO: 116381 - DNA, 461 bp, Homo sapiens
  Payload ID: 2707
  Gene Symbol: CENPN
  Gene Name: centromere protein N
  ENST ID: ENST00000562943
  CDS Start-End: 1-317
caggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtaaatctttattttctctttgacacaggagttagaagctactgggaaaatctacctccgacaagaggagatcattttagatattaccgaaatgaagaaagcttgcaattagtgaacatgaaaggaaaataaaaattcctcacagtca

SEQ ID NO: 116382 - DNA, 4085 bp, Homo sapiens
  Payload ID: 2708
  Gene Symbol: CENPO
  Gene Name: centromere protein O
  Uniprot ID: Q9BU64
  ENST ID: ENST00000260662
  CDS Start-End: 128-1030
ttgaagacgtggatggcgggaattctcgcttctggcctgggtgagctagaagggagaagcaaggacattggagtccctatcaccggttgcctagacaacttcatgggaaggcccttgggaatctgagatggagcaggcgaaccctttacgtccagatggcgagtccaaaggaggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacacaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccagctgtgccactggacatacctgaatgttgcccatgacccccgtggactccatcctgctggctacattgactgtattgccccagatgtcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgccaccccccccccatatgcagatttactcggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcagcatgaagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccacgaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttattt

SEQ ID NO: 116383 - DNA, 4386 bp, Homo sapiens
  Payload ID: 2708
  Gene Symbol: CENPO
  Gene Name: centromere protein O
  Uniprot ID: Q9BU64
  ENST ID: ENST00000380834
  CDS Start-End: 426-1328
atgcgccccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctggcaaggacattggagtccctatcaccggttgcctagacaacttcatgggaaggcccttgggaatctgagatggagcaggcgaaccctttacgtccagatggcgagtccaaaggaggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacacaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccagctgtgccactggacatacctgaatgttgcccatgacccccgtggactccatcctgctggctacattgactgtattgccccagatgtcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgccaccccccccccatatgcagatttactcggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcagcatgaagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccacgaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttatttata

SEQ ID NO: 116384 - DNA, 4272 bp, Homo sapiens
  Payload ID: 2708
  Gene Symbol: CENPO
  Gene Name: centromere protein O
  Uniprot ID: Q9BU64
  ENST ID: ENST00000473706
  CDS Start-End: 330-1214
atgcgccccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctgggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacacaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccagctgtgccactggacatacctgaatgttgcccatgacccccgtggactccatcctgctggctacattgactgtattgccccagatgtcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgccaccccccccccatatgcagatttactcggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcagcatgaagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccacgaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttatttata

SEQ ID NO: 116385 - DNA, 3088 bp, Homo sapiens
  Payload ID: 2709
  Gene Symbol: CENPP
  Gene Name: centromere protein P
  ENST ID: ENST00000375576
  CDS Start-End: 765-1073
gaattttcatagcgcatgggggaaaccagactctcccagaaccgcaagcctagaaatctgtgagattccacttgatttccctgcttttgggaggaggcttttgaccataaaatgccgtctcatcatgaagctgactttcaccaaggtaggccctttcccttactgcagtgggagccgcaccaccactgggcacagtgaggataccagggtgggctcctgcccatgcccaggacggtgtgtgggctggacaccactggggtgagtcctgaggacggacaggcgaggggcgtccaggctcggccacagccctcacggagcctcagctcaaagggcttttcaggtcagatgctaaaaccgtgagaaaacagctgctttccagcaaagagcctgacgcatccgcttggggaatcctctgaccagtcctctccagaccgtctgggttgtgacagacaagggcagaccaaggagccatcccagatggaaagggtgtggggaaacctgtgaaatgagaatacagctgtagggaggttatgtacaatgttcatgatggggaagcagcagtcatgggagcctggaggctgtggagagacctacagtggggcggacgtgtgtgacagcaagggcaagaggggcggttggcacccatggatgctgcgcaaacactcggaccctgattttcgccagacacctggaacggtgccccgtgcccctcccatggcccctttctccccaccagtggatctgtctacccgtttcttctccccatgcaggaaaagtacccagatgccgtgtacctctcggaggggccctcctcctgctccatggggatccgcagcgccagccggccagggtttgaattagtcattgtttggaggatacaaatagatgaagatgggaaggtttttccaaagctggatcttctcaccaaagtcccacagcgagccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaaactctcatgacatgaaaaataaatacaactagttaagtataaaatgccaaataaaagtgacacgtacaatgtggtttataaaaataagcttaacatctgagaaaatgtaccaagtggttgtgtgtcctcagatgtgtggggaggatccatcccccacccactgcagcctcacaccgagtccaccttggacatggtggccacattactcagctgggagaagccacccttatcctggttcctgcctcctgggggctctggagacggatgcctatggcgcctcatctttaaactgtccttagtagcccaggggagccacaccctcactccctgcctccccccggtccgcatggtggcaccgtgaggcagtctcagcaagtcctcatgctgttcttggtcttccacaagaaagtgaagctgtcagcttaataacaagaatggcctaagacagcaaagacagcactgttcctgggctgggacgcaaggaatgaggtcctttatgaaagaaagacccccctgcatagcctaagtgctatatcgatcgtcccggatgtgccttaagaaccgtgacctcatcagtcgcccatttagcattgttaagatctgtgaacgcgtgttgtctcaaaccagtcagggccgtcatgactacgcagcagcagcagtttccaagacgggccagaaacgcatccacagcagtggcacccgcggctcaggggctcctcacagcccgggctggtgggagccaagaccagacagagtgggggtctccatctgttttctcttctccctcaaatacaggctgttttcatcgtgtctagtccagccctgtctgggccctgtgctaggcaataactcttgcagccctgaaggacctagggagcccagcccaccttcccacggactggggttccctcacatgtgcacttgaacccaggacccagcatcctccacacaccgtgacaatgggcaaaatcatcccaaaccaggctgccccagccccagcccagcaacagtgaactcccttgggtcaagacagtactcaacggccactacctccacgcttcccagagcctgcggcttgtccgtgagctccgtgcacttcaccaaagcccccatcccagcacacaggacccgtgtgtatgagacggtgtcattggaagtgagaagaaaacagtaaaagtgtccagttagataagtatctttttgcacctctgagagtagaattagaagtaaatatgacagaattgaacaataaattctagaagagttgccttgattcaaacaagtataattctcaagttatcacaaaatttcccacaaaaatttacaatcagcaaaatagtttccttatttctcatgtatcattttcatataattccatggtttcactaatattatatgttacaataagcctccattagtccctcaaaacgatgatataaataagtctgtacaacctagcatagaataaaaaactgaaaccaagattcccaacgtttttcatagcagccgggcacactttggtgaccccaacgagaaccctctcggcagcagccaggagctgttcaccttccagaagcagggcctgtggcagcctaacagggagaggccacggggcccaaaaacgcaacacgtctcaaggcaaacccgagggaggaacttggtctgggaggaagagagaactcgctcctcaaccaccccagacactggagtgtcaggaaagcactgagctgttggggcacactgcccagcccggccacagcagctcagccagtcacagctccacctccaacttctacagcagcaatttttagtgggaaagaacagctcatctccccctcatgtgaaagattaaattgtaaagcaaaaaaaaaaa

SEQ ID NO: 116386 - DNA, 2570 bp, Homo sapiens
  Payload ID: 2709
  Gene Symbol: CENPP
  Gene Name: centromere protein P
  Uniprot ID: Q6IPU0
  ENST ID: ENST00000375579
  CDS Start-End: 208-555
tttgctgtctcctgccctggctctcttcctgtccatacaggcccattattcatgcttgcatttgctgtttgtttattaaaattccccagctcttcgttttaaaaatgccattgggatatatttccagtagagtgggtctctttcaactctgggtttccctggttcttcccaagtctgtacaaacaagaaaagttgggtcaagggaggatggaggctcccagctggtctgttctgcaaaggtctggagatgaggaaaagtacccagatgccgtgtacctctcggaggggccctcctcctgctccatggggatccgcagcgccagccggccagggtttgaattagtcattgtttggaggatacaaatagatgaagatgggaaggtttttccaaagctggatcttctcaccaaagtcccacagcgagccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaaactctcatgacatgaaaaataaatacaactagttaagtataaaatgccaaataaaagtgacacgtacaatgtggtttataaaaataagcttaacatctgagaaaatgtaccaagtggttgtgtgtcctcagatgtgtggggaggatccatcccccacccactgcagcctcacaccgagtccaccttggacatggtggccacattactcagctgggagaagccacccttatcctggttcctgcctcctgggggctctggagacggatgcctatggcgcctcatctttaaactgtccttagtagcccaggggagccacaccctcactccctgcctccccccggtccgcatggtggcaccgtgaggcagtctcagcaagtcctcatgctgttcttggtcttccacaagaaagtgaagctgtcagcttaataacaagaatggcctaagacagcaaagacagcactgttcctgggctgggacgcaaggaatgaggtcctttatgaaagaaagacccccctgcatagcctaagtgctatatcgatcgtcccggatgtgccttaagaaccgtgacctcatcagtcgcccatttagcattgttaagatctgtgaacgcgtgttgtctcaaaccagtcagggccgtcatgactacgcagcagcagcagtttccaagacgggccagaaacgcatccacagcagtggcacccgcggctcaggggctcctcacagcccgggctggtgggagccaagaccagacagagtgggggtctccatctgttttctcttctccctcaaatacaggctgttttcatcgtgtctagtccagccctgtctgggccctgtgctaggcaataactcttgcagccctgaaggacctagggagcccagcccaccttcccacggactggggttccctcacatgtgcacttgaacccaggacccagcatcctccacacaccgtgacaatgggcaaaatcatcccaaaccaggctgccccagccccagcccagcaacagtgaactcccttgggtcaagacagtactcaacggccactacctccacgcttcccagagcctgcggcttgtccgtgagctccgtgcacttcaccaaagcccccatcccagcacacaggacccgtgtgtatgagacggtgtcattggaagtgagaagaaaacagtaaaagtgtccagttagataagtatctttttgcacctctgagagtagaattagaagtaaatatgacagaattgaacaataaattctagaagagttgccttgattcaaacaagtataattctcaagttatcacaaaatttcccacaaaaatttacaatcagcaaaatagtttccttatttctcatgtatcattttcatataattccatggtttcactaatattatatgttacaataagcctccattagtccctcaaaacgatgatataaataagtctgtacaacctagcatagaataaaaaactgaaaccaagattcccaacgtttttcatagcagccgggcacactttggtgaccccaacgagaaccctctcggcagcagccaggagctgttcaccttccagaagcagggcctgtggcagcctaacagggagaggccacggggcccaaaaacgcaacacgtctcaaggcaaacccgagggaggaacttggtctgggaggaagagagaactcgctcctcaaccaccccagacactggagtgtcaggaaagcactgagctgttggggcacactgcccagcccggccacagcagctcagccagtcacagctccacctccaacttctacagcagcaatttttagtgggaaagaacagctcatctccccctcatgtgaaagattaaattgtaaagcaaaaaaaaaaa

SEQ ID NO: 116387 - DNA, 8766 bp, Homo sapiens
  Payload ID: 2709
  Gene Symbol: CENPP
  Gene Name: centromere protein P
  Uniprot ID: Q6IPU0
  ENST ID: ENST00000375587
  CDS Start-End: 516-1382
gcctccgtcacctccccctcaacgactgcaaaagagcctaaaccaaaatcccctagtttctattgaacactatcgctgtgtgtaccaattcctggactaggtcggcgtaagagaggaagtaggtgaaaaaaataaagaggcgctcccctccacgtgatcccagccctgcctctttagtgaggcacgcggccgggcggctccaaggctgccggctagggtgagcagcggagcgcttgggcttggagtagcaaagaacgcgctctccagagaaagtatagccactgcttagacagccagggaaacgtgtgcggggaagtggaggactcaggctctcgtgcgagagcggagttggacgtgcagggccgctggggtcacgcggagctctcccgcctcccctccgcgtgagctctgggatggtccgcgccgggagcgcgcgcgaggcttgaagcgcgggtgaagcgcgcaggtcggagtgacagctgcgctgccggcccggctgcggtcagcaacgcgccatggacgcagagctggcagaggtgcgcgccttgcaagctgagatcgcggccctgcggcgagcgtgtgaggacccaccggcgccctgggaagagaagtcccgagtccaaaaatcttttcaagccatacaccaattcaatttggaaggatggaagtcttcaaaagatctgaaaaatcagcttggacatttagaatcagaactttcatttctaagtacgcttactggcatcaatataagaaatcactccaagcagacagaagacctaacaagcactgagatgacagaaaagagtattagaaaagttctacagagacacagattatcaggaaattgccacatggttacatttcaacttgaatttcagattctggaaattcagaataaggagagattatcttctgctgttactgacctcaacataataatggagcccacagaatgctcagaattaagtgaatttgtgtctagagcagaagagagaaaagatctgttcatgtttttccgaagcctgcatttttttgtggagtggtttgaatatcgtaagcgcacgtttaaacatctcaaggaaaagtacccagatgccgtgtacctctcggaggggccctcctcctgctccatggggatccgcagcgccagccggccagggtttgaattagtcattgtttggaggatacaaatagatgaagatgggaaggtttttccaaagctggatcttctcaccaaagtcccacagcgagccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaaactctcatgacatgaaaaataaatacaactagttaagtataaaatgccaaataaaagtgacacgtacaatgtggtttataaaaataagcttaacatctgagaaaatgtaccaagtggttgtgtgtcctcagatgtgtggggaggatccatcccccacccactgcagcctcacaccgagtccaccttggacatggtggccacattactcagctgggagaagccacccttatcctggttcctgcctcctgggggctctggagacggatgcctatggcgcctcatctttaaactgtccttagtagcccaggggagccacaccctcactccctgcctccccccggtccgcatggtggcaccgtgaggcagtctcagcaagtcctcatgctgttcttggtcttccacaagaaagtgaagctgtcagcttaataacaagaatggcctaagacagcaaagacagcactgttcctgggctgggacgcaaggaatgaggtcctttatgaaagaaagacccccctgcatagcctaagtgctatatcgatcgtcccggatgtgccttaagaaccgtgacctcatcagtcgcccatttagcattgttaagatctgtgaacgcgtgttgtctcaaaccagtcagggccgtcatgactacgcagcagcagcagtttccaagacgggccagaaacgcatccacagcagtggcacccgcggctcaggggctcctcacagcccgggctggtgggagccaagaccagacagagtgggggtctccatctgttttctcttctccctcaaatacaggctgttttcatcgtgtctagtccagccctgtctgggccctgtgctaggcaataactcttgcagccctgaaggacctagggagcccagcccaccttcccacggactggggttccctcacatgtgcacttgaacccaggacccagcatcctccacacaccgtgacaatgggcaaaatcatcccaaaccaggctgccccagccccagcccagcaacagtgaactcccttgggtcaagacagtactcaacggccactacctccacgcttcccagagcctgcggcttgtccgtgagctccgtgcacttcaccaaagcccccatcccagcacacaggacccgtgtgtatgagacggtgtcattggaagtgagaagaaaacagtaaaagtgtccagttagataagtatctttttgcacctctgagagtagaattagaagtaaatatgacagaattgaacaataaattctagaagagttgccttgattcaaacaagtataattctcaagttatcacaaaatttcccacaaaaatttacaatcagcaaaatagtttccttatttctcatgtatcattttcatataattccatggtttcactaatattatatgttacaataagcctccattagtccctcaaaacgatgatataaataagtctgtacaacctagcatagaataaaaaactgaaaccaagattcccaacgtttttcatagcagccgggcacactttggtgaccccaacgagaaccctctcggcagcagccaggagctgttcaccttccagaagcagggcctgtggcagcctaacagggagaggccacggggcccaaaaacgcaacacgtctcaaggcaaacccgagggaggaacttggtctgggaggaagagagaactcgctcctcaaccaccccagacactggagtgtcaggaaagcactgagctgttggggcacactgcccagcccggccacagcagctcagccagtcacagctccacctccaacttctacagcagcaatttttagtgggaaagaacagctcatctccccctcatgtgaaagattaaattgtaaagcaaaaaaaaaaaggtcaatgctcgcatgagtggtgtccatcctgacctgagccttgcgctccctgctgccctgtgtggaactgtgggcttcagcacctccacagggaccctgagtctacactgctcagaatcggcatctgcgcgaccacgaggtcacgctgtgcagcagggaaccacctaaaaacctgtgttgatatgtggcttgcactgaaaaagtgaccatgtaactcagctgggggaagttccagtagtatccatgttttcttaaaagtccaaactgtaaaatgtatgtgacaattcaagttttctatgttaggagtctggtggtagcagatccaaaccttgggtcttagaataaggcttttcgcattagagaatcagacatgagccctggttgggaaagaagaactatccagaacgtcttcccagggcttaacggacacttccattttaagagtgtgagcagcttcctgggacacagcactcacttcctacattccttgtccaggaagttgtttctagtgctcttcaattccatgtctccaagaggcaatcccacctcaaaaggggttaaaagcaaaaacattcacaaccaaaggtcacccaacacaacagaaaatatctctatcattcagccttcacattatgttcaagtttcaaagacactgcagggaaagagttagaccttgtggagaactaatgtgcaatcttcgctttccttgaaccgagtcgacatcacggcgttgtctttggcacgtacagtctttgaataatagttgacgatcttgccgtccagtttatactgatggggaatgctctcgtagggcttgaggtcaaggtccagcacagacacggaaaaggcaaacctggacctcgatgaagggacgacaggcctttgatcagagctgcaagtaaaaagtaccatttcaggatacacaagccccccattcatttccctccctcccgttctctctccctttcttctttcaactagtatgtttttatgttttttctttgacttctgcaaagttagataaatcaatctcttttaaaagagaagtgaatggcctcacaccccagctcacaaagagcactcgttctgtgcacctgtgatctgtgcgtgtgacagctgtctgtgccggctgtgtgcaccagcgtgcaaagcttcctcaggccagtgcaccccaccataccaggcgagagagggttaaaggactgaaagatggaaaagtaattatgtggaacatgtgagcgatgttcccccagcccagtggtataaacgaacgctgaaaaatcactttatcatgagccaagtattacaaaacccaacaaaaagtaaaaagtagatctggccattccagcgccaaatggatggaatgtcgacaagccttcttctttgcctctcctgtctgctgagaaacgcaagctcctttggttcacatttgaagagatctggtttctcattttattctcaaattttatcttcagtcctttgtattttgcttctcagggcttagttttgtggttttaacctcagaagtcgtgtgcttataacaagatgtgattaattatttgccctgaaaaacacatttaggattactccgagtcctgagctctgactgctgtgtgtcccgcttttcgtctccgggcactcagcgcacagcactcaagacactggctaaacaagtgacctaagctcagttcagtccaagagaagtatcctgggttctggtgtcccaatgtttactacgctttgagatttagaaatcaacaagccaaaccccaacttcaaaagctcctgccgaggagaggaaatactgatcagcacgtccctgctctgacgctgctcaccatggccttggcgctcactgctgccctgccccagaatcctgtttgtagaaaaaacaaatccctgactaagctgctggggtaagtaactattctcatctgaagagtaaacagcaaataactcatttacaaattaaggtcatgagtctcgctccagaagctggagtgtgcctgcagctcatcccaaggggccacattttattgggagaacctcagaagcccaaggtactgctcagttctgaggcctgagacccaagctgggtgcacctgggctggaacagtcacatccccagcccatgactagggttacgtattttaaaggacaccccaatttctcagaagcagcacctgacaagaccatgggtgtaaagacaggaaggatgttccaggcagctcccggggagggtctgactacctgggtcaaccacaagctagctccatgggaaccaatggcagtgaccagcgggcaccagctcctgacacagaaatgctcttcttccccctcagtaccccggaggccaagactgggcaagaggccccagggacacacctgtcccttgtgccacaagtgtgccctctagcagccttggagaatgaggctcaggtggccttctggctgcaggggggcagcccttgcctggaaggccgttctccaggacactgacccgctgggggttaccgggggaccagcagcctccaagggtgctggggatcggggtggagaagccaaggccgcacactgtgtttcaaatgggaggtcgagaggagcatcagggtttaggccgggaagctgtggcagctctctccacagttccaaattcccaaagggacaaagctctgcagcgacaggaaggcagatccaacttgagacattttcctttatgacagggcagaaacagtagtgcagagctggagaagcctttattttagggggtgtaagaagtttaaatgtggtcaatctatctgtgagctgcaaattagtctagggatctaaatttagtctcaggtctaccaggtatctcaagacgccaagatgactcatgataaatcccagccttagtttgtccctaggcctctagagcaccacagttactggaacttcacaggtgcggccactgcgcacaccttcctggaagcaggcccagccccacacgccatgttctcggaggagaagccttctctgagatcctctccttttgttgagaaaggcctggctagagtgctttgtgcaggatggttccagtgcctacaccctaggtctgagaagccacatggctcagtgccttcaggacatgccctcccctcccctcctagtgtcgtttctgctgagcagctggtcgtaaggacccgggccttcagctttccccgcatgctggctttccaatttgacatcactgaccaggcactaagagattcccaggtgctagacgaggtgagtaacatgtctgtccttcagcggcctttcacagcccacctaagggcaccctgcatccaagcacatttccattgcccagctgcatccttggtcggggggctgctgaacagtggtatcttcgtgggttttctctcatcgaacaccaccagcttaatccagttaaggaattcctcataacttagccctgtaggtatttccttaggggataacaggagttttcaactaaatagaacaaccttttttctacttcagttagccctataatgttcctcagtatttcatattggaaagtaaacaattctgtgcctgccagggaacaggaatcctgggaactgtttagttcaaaagcaccgggaaagtgagtggctggcagccagcaaccaaggtcatcttgacccaggaacacatgttagaagaatgtggaacattccgcaaatactgggtgcagggtttagcacccctgaagatcggtgatggagatgctgtctaacgactatgagattatcagtttcatcccgaattcccagaaacagaggggactggacaaaactagtgacattagggagaggggcggcacataggctggttattcagaagaggaagcagaatgaatgcgcgcctcacaggctttcaaatgactgtggtggtaaaaaggcaggtgcgccatgctgccactgtgggagaccgaggaacaagggccacaggtacccacacatctcaggggctggctttctttgagggaatgcaatgggcagctcactgtccacattgtttctgagctcttgggagtattttcttagaaaacagtaactttcaatgtactaacaatccttttaagttattctccataaatctgtcttttgactgaattacaagcttctagagggcgagagttagtaagccccatgatgtcacataggccaaggaagttatgtcactccgccatggagtctctaaatatggggaaaccaactatcctattaacaattcaccaactgtccataaaaccccgttagacccaggctgcatgccttgcagtgggggcctcacctggcatcctgcagacagggagacagtgcaatcatgatggagcagtccttggcagtcatggcgacgcggtactgctgcacctgcaggggcgggaaagatcagctccaggtcacacaggaagcctctgcccccccacacaaccttccttcccagtagccaagtgtgggaactgcttcctgcctcagaacctgagggtgggattaggagcgagggccacggtgagcacgggcgtcaggaggtcgccctgtgagagcacctgggccagccctcagtgccacggggctgctcagaggccagcaccgccccctgacctctcacggcaagcagtgtgggaccccgactccagaccctgagacggatgatctgtcttcagcaaggtcaccacagtcggcctttggaaggaaaagcagtaagccacctgagccccgcatgttggccacactcagagtatcaagtgagtatcactcgacacctgcaaggagagcgcagggggtgttcagcaaggcatcgcttagaacgacattccctccggaacatcatacagccaccagagacaacggcagacggccacccttctacaggctgtgcatgtgttaacttgctccaccctcacagcagcccaacagggcagcacggccggcgtcccactttacagacaagcaacagacacagacatcacttgtctgtcatgccctgcttgtcaatggcaaggcagggactcaaacccggtacgctggctctgacatttacactcttcaacacatgctccaagctatgtgggtctgtccatactgaccagggacagctcaacacacaccacactgtcagagtcgacatacgtaaagctgtacatgtgcacatgtgtgtgacgcgggcagggagaaaggtgaaggacaggcaccacaatgctcacaactgtctcctctacagagcagaatgtgaggcactctctcctcttccttctttggactttcatatatggtttgcattgttttagatggcatagctctcgctttcacaaaaataaacagttgtaaaagaaaaggaa

SEQ ID NO: 116388 - DNA, 570 bp, Homo sapiens
  Payload ID: 2709
  Gene Symbol: CENPP
  Gene Name: centromere protein P
  ENST ID: ENST00000618653
  CDS Start-End: 1-570
atggacgcagagctggcagaggtgcgcgccttgcaagctgagatcgcggccctgcggcgagcgtgtgaggacccaccggcgccctgggaagagaagtcccgagtccaaaaatcttttcaagccatacaccaattcaatttggaaggatggaagtcttcaaaagatctgaaaaatcagcttggacatttagaatcagaactttcatttctaagtacgcttactggcatcaatataagaaatcactccaagcagacagaagacctaacaagcactgagatgacagaaaagagtattagaaaagttctacagagacacagattatcaggaaattgccacatggttacatttcaacttgaatttcagattctggaaattcagaataaggagagattatcttctgctgttactgacctcaacataataatggagcccacagaatgctcagaattaagtgaatttgtgtctagagcagaagagagaaaagatctgttcatgtttttccgaagcctgcatttttttgtggagtggtttgaatatcgtaagcgcacgtttaaacatctcaaggtaaag

SEQ ID NO: 116389 - DNA, 1733 bp, Homo sapiens
  Payload ID: 2710
  Gene Symbol: CENPQ
  Gene Name: centromere protein Q
  Uniprot ID: Q7L2Z9
  ENST ID: ENST00000335783
  CDS Start-End: 95-901
gtctcctctgtttacgaatgtttgggcgcgaattactctaagcgcggctctcagaagggtgcaagaagaatcagtgcactgtgtttagatcaagatgtctggtaaagcaaatgcttccaagaaaaacgctcaacagttaaaaagaaatccaaagagaaaaaaggataatgaggaagttgtgttgtcagagaataaggttagaaacacagtgaaaaaaaataaaaatcatctgaaagatctgtcttctgaaggacaaacaaagcacactaacctaaaacacggaaagacagcagccagcaagagaaaaacctggcaacctctgtcaaagagtaccagagaccatttgcaaactatgatggaatcagtaataatgacaattttgagtaacagtattaaagaaaaagaagaaatacaataccatctcaacttcctgaagaaaagattgctacaacagtgtgaaactctgaaagtccctcccaaaaagatggaagatttaactaatgtatcaagtctactgaatatggaaagggcacgagacaaagctaatgaagaaggtctggcattactacaggaagaaatagataaaatggtagagaccacagagttaatgactgggaatattcagagcctaaagaacaaaattcagattctggcaagtgaggtggaagaagaagaggagagagtaaaacagatgcatcaaataaatagtagtggagtactctctcttccggaactttctcagaaaactctcaaagcacccacacttcagaaagaaattttggcgctaattccaaaccagaatgctcttctaaaggacttggatattcttcataattcatcacagatgaagagcatgtcaaccttcattgaagaagcctataagaaactggatgcatcttaaagagtgttttttttttagattgttccatattaatttaatgttcgtgaatttgtaaaactgttaacctatgattatatgtacagaggctaaggcttctgcaggatttattatctcctgatatgcactttaaaattagtctttgtagttctatcattagcatctaatgtagttctgaagactgtttttagcagttgccaaatctaggaaactaacatttatattgctgtatctataagtatttgcctaaaaccataaaataggaattgccttaaggatctagtagtttataatgcctgaatggaactcatttattggttaacagctcatatcaggagctgtgataagtaagtgtttacatacactgtctagtgcataaaaaccttagtgtttgctatcattcattctgtagccaatggcttacagtttctgtctggtcatctggaacttgaaaaatcctcaaatgccttcactcttttacctaactccctagtctttttgggaagtagttaagatatgcctgctatctttaactttggaggtagtatcaaaattttacttctttggttgtttagtgaattaatgttgaatattttctactgtcatcaaaacatattcccaaaaagtattaaaaaggaaccttagcacatttattttattaaaacaagaaaacccaaaatatataaaccttttcttattatgataataagcttatatatgtgaataagttataacctagtgtataaaaaattatttctaacaaactacagtatactgtcttgggtttttttttttttttttagtctgtaaaataaaatgactgcaattacttttt

SEQ ID NO: 116390 - DNA, 2200 bp, Homo sapiens
  Payload ID: 2711
  Gene Symbol: CENPT
  Gene Name: centromere protein T
  Uniprot ID: Q96BT3
  ENST ID: ENST00000440851
  CDS Start-End: 409-2094
cttgtctcaggtatctgataatttacacttgatctcagtgcagattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgaggctgcctccaaagcatccggagtttgcaaccatcactgtccaccccgcgagctgcgatagtgcgagaactacaattcccgtggggctgtgcgggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaac

SEQ ID NO: 116391 - DNA, 673 bp, Homo sapiens
  Payload ID: 2711
  Gene Symbol: CENPT
  Gene Name: centromere protein T
  ENST ID: ENST00000561593
  CDS Start-End: 480-673
agatcctctaagacaagacagggataaagtctcccgtggaatcccctcccgcctcatattccctgaccctgccctccctgcgagaactccagtccgggctccacaaagggcgcgattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgaggctgcctccaaagcatccggagtttgcaaccatcactgtccaccccgcgagctgcgatagtgcgagaactacaattcccgtggggctgtgcgggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatgg

SEQ ID NO: 116392 - DNA, 631 bp, Homo sapiens
  Payload ID: 2711
  Gene Symbol: CENPT
  Gene Name: centromere protein T
  ENST ID: ENST00000566067
  CDS Start-End: 85-324
atcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccagggcagacggacagactggttgcttggtgctttgccgatagtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggc

SEQ ID NO: 116393 - DNA, 633 bp, Homo sapiens
  Payload ID: 2711
  Gene Symbol: CENPT
  Gene Name: centromere protein T
  ENST ID: ENST00000565114
  CDS Start-End: 488-633
cccagatcctctaagacaagacagggataaagtctcccgtggaatcccctcccgcctcatattccctgaccctgccctccctgcgagaactccagtccgggctccacaaagggcgcgtgcagattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgaggctgcctccaaagcatccggagtttgcaaccatcactgtccaccccgcgagctgcgatagtgcgagaactacaattcccgtggggctgtgcgggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccag

SEQ ID NO: 116394 - DNA, 583 bp, Homo sapiens
  Payload ID: 2711
  Gene Symbol: CENPT
  Gene Name: centromere protein T
  ENST ID: ENST00000562338
  CDS Start-End: 73-417
acattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccaccctctccttggtgtttctgcagccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtg

SEQ ID NO: 116395 - DNA, 1005 bp, Homo sapiens
  Payload ID: 2711
  Gene Symbol: CENPT
  Gene Name: centromere protein T
  ENST ID: ENST00000562462
  CDS Start-End: 80-301
gagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaagtaaggttgggttttcccctgctggcctttggggaaagctctccccgctatgacagataggaggtgatgctgagtcagggttgcacccctctcggtggggtcaaggacagcgagcaactctggtcagtgggtctacaaggaatttctgcttgctttctacagggggcctctttccttggtccctcggtgtctcccagggccccatatccttagactatagggctggaggttgtaaaggggtgtggtgtggtggccaaaacttgttgagaggggccaggtttcaggatcagctggccaattcaaactgacct

SEQ ID NO: 116396 - DNA, 507 bp, Homo sapiens
  Payload ID: 2711
  Gene Symbol: CENPT
  Gene Name: centromere protein T
  ENST ID: ENST00000568069
  CDS Start-End: 71-292
attaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggccccagaatcttccatcctgatgcctgagtcggtagtgaagccagtgccagcaccgcaggcggtccaaccctccagacaagagagcagttgcggcagatccctcaacctgacctttgccacacctcttcagccacagtcagtgcagaggcctggcttggcccgcagacctccagcccgccgagctgtagacgtgggtgcctttttgcgggatctgcgagatacttccctggctcct

SEQ ID NO: 116397 - DNA, 1638 bp, Homo sapiens
  Payload ID: 2711
  Gene Symbol: CENPT
  Gene Name: centromere protein T
  ENST ID: ENST00000564817
  CDS Start-End: 60-1580
cggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatattt

SEQ ID NO: 116398 - DNA, 822 bp, Homo sapiens
  Payload ID: 2711
  Gene Symbol: CENPT
  Gene Name: centromere protein T
  ENST ID: ENST00000565713
  CDS Start-End: 85-390
atcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggacggacagactggttgcttggtgctttgccgatagtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaa

SEQ ID NO: 116399 - DNA, 2345 bp, Homo sapiens
  Payload ID: 2711
  Gene Symbol: CENPT
  Gene Name: centromere protein T
  Uniprot ID: Q96BT3
  ENST ID: ENST00000562787
  CDS Start-End: 550-2235
acccatgctgactctggagcgggccgggtggcgctgcccatccccggatccttcgtagatggagtcttgcttagtcgcccaagctggagtagtgtggctcgatctcagctctgcaacctctgcctcccagggttcaagcaattctcctgcctcagtttccagagtagctggaattatagtgcagattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgaggctgcctccaaagcatccggagtttgcaaccatcactgtccaccccgcgagctgcgatagtgcgagaactacaattcccgtggggctgtgcgggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 116400 - DNA, 858 bp, Homo sapiens
  Payload ID: 2711
  Gene Symbol: CENPT
  Gene Name: centromere protein T
  ENST ID: ENST00000566758
  CDS Start-End: 27-858
ggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaa

SEQ ID NO: 116401 - DNA, 575 bp, Homo sapiens
  Payload ID: 2711
  Gene Symbol: CENPT
  Gene Name: centromere protein T
  ENST ID: ENST00000567985
  CDS Start-End: 556-575
aaactccacttgcactgtgagatcgatgggcttcacgtcttctccagtgggagtgatgggcgccggctgtacggatcccggagcctgactgctgtctacagtggcctgaagggtgagaagcacggccgcggaagcagataccaggttcggctgcagctgggcagtctgggcagtggaggcagaggtgcagattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgaggctgcctccaaagcatccggagtttgcaaccatcactgtccaccccgcgagctgcgatagtgcgagaactacaattcccgtggggctgtgcgggagcatcgcgagagttacattaactgtggcggcgggaaggcggagcctgcagctggctgggcggttaggagggcccggggccgagacgatggctgaccacaaccctga

SEQ ID NO: 116402 - DNA, 1669 bp, Homo sapiens
  Payload ID: 2711
  Gene Symbol: CENPT
  Gene Name: centromere protein T
  ENST ID: ENST00000562513
  CDS Start-End: 2-493
gatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagacttggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacag

SEQ ID NO: 116403 - DNA, 1737 bp, Homo sapiens
  Payload ID: 2711
  Gene Symbol: CENPT
  Gene Name: centromere protein T
  ENST ID: ENST00000626059
  CDS Start-End: 38-259
gctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcat

SEQ ID NO: 116404 - DNA, 1998 bp, Homo sapiens
  Payload ID: 2712
  Gene Symbol: CENPU
  Gene Name: centromere protein U
  Uniprot ID: Q71F23
  ENST ID: ENST00000281453
  CDS Start-End: 72-1328
cggattggctgttcggagcggcgaggggcttggcgggagcttccagtcgctcgagagcggagagcggcaccatggccccgcgggggcggcggcggccgcggcctcacaggtctgagggcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcaga

SEQ ID NO: 116405 - DNA, 688 bp, Homo sapiens
  Payload ID: 2712
  Gene Symbol: CENPU
  Gene Name: centromere protein U
  ENST ID: ENST00000514781
  CDS Start-End: 158-688
ctggatctggcgggaagggtctcggcttgctgcagacggtgcacaaagccatacgccaagacgatctgaagagaacaggagttcccccgggcctgggaaggctgcctggaggaggagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcg

SEQ ID NO: 116406 - DNA, 1549 bp, Homo sapiens
  Payload ID: 2712
  Gene Symbol: CENPU
  Gene Name: centromere protein U
  ENST ID: ENST00000510146
  CDS Start-End: 69-1031
attggctgttcggagcggcgaggggcttggcgggagcttccagtcgctcgagagcggagagcggcaccatggccccgcgggggcggcggcggccgcggcctcacaggtctgagggcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaa

SEQ ID NO: 116407 - DNA, 1165 bp, Homo sapiens
  Payload ID: 2713
  Gene Symbol: CENPV
  Gene Name: centromere protein V
  Uniprot ID: Q7Z7K6
  ENST ID: ENST00000299736
  CDS Start-End: 64-882
ggcgcgcgcaggccggcgggggcgcgccgcgctgcgaggcctgcgcgccaggctgcgggagccatgcggcgatcgaggagctctgcggccgccaagctgcgcgggcagaagcggtccggggcctccgcggcccccgcggcctccgcggccgctgccttggcacccagcgccacccgcacacggcgctccgctagccaggccgggagcaagagccaggcggtggagaagccgccgtcggagaagccgcggctgaggcgctcgtcgccgcgggcccaggaggagggcccgggggagccgccgccgcctgagctggcgttgctcccgccaccgccgccgccgccgccgactcccgcgaccccgacgtcctcggcgtccaacctggacctgggcgagcagcgggagcgctgggagacgttccagaagcggcagaagcttacctccgagggtgccgccaagctcctgctagacacctttgaataccagggcctggtgaagcacacaggaggctgccactgtggagcagttcgttttgaagtttgggcctcagcagacttgcatatatttgactgcaattgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagca

SEQ ID NO: 116408 - DNA, 1770 bp, Homo sapiens
  Payload ID: 2713
  Gene Symbol: CENPV
  Gene Name: centromere protein V
  ENST ID: ENST00000476243
  CDS Start-End: 21-548
cgcgccaggctgcgggagccatgcggcgatcgaggagctctgcggccgccaagctgcgcgggcagaagcggtccggggcctccgcggcccccgcggcctccgcggccgctgccttggcacccagcgccacccgcacacggcgctccgctagccaggccgggagcaagagccaggcggtggagaagccgccgtcggagaagccgcggctgaggcgctcgtcgccgcgggcccaggaggagggcccgggggagccgccgccgcctgagctggcgttgctcccgccaccgccgccgccgccgccgactcccgcgaccccgacgtcctcggcgtccaacctggacctgggcgagcagcgggagcgctgggagacgttccagaagcggcagaagcttacctccgagggtgccgccaagctcctgctagacacctttgaataccagggcctggtgaagcacacaggaggctgccactgtggagcagttcgttttgaagtttgggcctcagcagacttgcatatatttgactgcaagtaccggaattatatatgaataataagcacatacgatggaattactcaaatggagaactgaccaggctactaacaatagagtccagattggaaaagaagcactgtggaataacttgtgagaggattctgtgctaaattagaactttttcaaaggtggcctgaaaagaggggacttcagtttaattccagagatggtaattctggggacgtgttttacttggagctggacttcttgtgacgtggtgatgaagaaagagggaaacctaaacttccttgtccatttttggtgtggatgtctcagagacatcaggttgtagcagtgtctgaaatttgtttcctaagtgtctctgaagtccagcgcttctcttcactgtaaagaactgaggggtgggcagtacagacctgtctgttggtcctgtgttctgagcattgcagaacctcgactgctgacttgggacccccctgggctctgctgtacctgcaaaccagaggcactgctatccaggcctttgccccagctcctcggccctggatggtgctgaaaggggcatcatctgtggggtcggctggctctcatggctgggccgctcaggcatagaggatgcaggtggctgctcacaatctggaatttgctctgtctttctgtagttgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagca

SEQ ID NO: 116409 - DNA, 473 bp, Homo sapiens
  Payload ID: 2713
  Gene Symbol: CENPV
  Gene Name: centromere protein V
  ENST ID: ENST00000482983
  CDS Start-End: 1-45
gcagacttgcatatatttgactgcaagtaccggaattatatatgaataataagcacatacgatggaattactcaaatggagaactgaccaggctactaacaatagagtccagattggaaaagaagcactgtggaataacttgtgagaggattctgtgctaaattagaactttttcaaaggtggcctgaaaagaggggacttcagtttaattccagagatgttgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgccccccactgcctggatgagggcactgtgcggagtatggtcactgaggaattcaatggcagc

SEQ ID NO: 116410 - DNA, 1620 bp, Homo sapiens
  Payload ID: 2714
  Gene Symbol: CENPVP1
  Gene Name: centromere protein V pseudogene 1
  ENST ID: ENST00000602548
  CDS Start-End: 1-819
atgggcagagtgaggaaccgcgccactgctcagcggcggaggcgaaagcggcccggggatcctcccgccgcctgcgcggccatcgcggtcacgggcgccagccgcgcgcagtgcccccgggtccaagtcggggtcgggagccacgcggcggccaagaggtggctgggtaggtggcgacggaagcgccgctggcggcgggtccggaaggcgggccccagagacctgctgccctccgcgccaaccccggacccgccggggcccgccccgtcccccaaggatctggacctgggcgcacagcgggagcgctgggagacgttcaggaagctgcggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccgaggagcacaaggccatccacaagacgtcctcccagtcagcccctgcctgtccccgcgaacaggagcagtgattggggccgcaagcccgcctgaaaccggcccgggcggccctgcggggagcgtccgagtacctgcacagatcccatgctgtgaaagaggtgtttctggcctggtcacaccggggattcccttccagtatttgcccttcccctccgctagttttcagtgaactcgcttacgatccaaatcttgaacacacctttgtctgcgtagtacaacgttaatcttgcaattcggtaaggaagaagagtgtctctgatttttcaaaccatccattgtatctctcgcttttactgttctgcctacagttgtcacaaatcacctgcagatgattcctgtgtactgtacgttcctggtgctattgtgaacaggcttgttgttttcagcgctttgcctctggtgtgtaggacggcaacacacaaccagtttgtaaacatgtgctaggacgtcttccattgattatggtgtgcgtgggctcccgcacctgtgagtttcaggtagacgttcatattttcactgcttagattcgagttatgctatttactggtttttaaatgatatatttcaagatttggtcgtgttacatacctcattactctttatttcctgtaacagcgaaagctgttactatttcgcttgttgtttgggaagtgtctctgggtaaggagatggggatacaggaatgagaaagacatctgtgcacacaggaatgagaaagacatctgcgcactgtctgccctctttaatcttttgaaatacctgtcttgtacatgtgttaagtatatagaaatcagtaaataccttctaggaaa

SEQ ID NO: 116411 - DNA, 864 bp, Homo sapiens
  Payload ID: 2715
  Gene Symbol: CENPVP3
  Gene Name: centromere protein V pseudogene 3
  ENST ID: ENST00000417339
  CDS Start-End: 1-864
atgggggtagcgggctgggcacgcgctccggaggctgcaggcgccatgggcagagtgaggaaccgcgccactgctcagcggcggaggcgaaagcggcccggggatcctcccgccgcctgcgcggccatcgcggtcatgggcgccagccgcgcgcagtgcccccgggtccaagtcggggtcgggagccacgcggcggccaagaggtggctgggaaagttgcggcggaagcgccggtggcggcgggcccgggaggcgggctccagagatccgctgccctccgcgccactcccggacccgccggcgcccgccgagtcccctaaggagctggacctgggcgcacagcgggagcgctgggagacgttcaggaaactgtggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccgaggagcacaaggccatccacaagacgtcctcccagtcagcccctgcctgtccccgcgaacaggagcagtga

SEQ ID NO: 116412 - DNA, 528 bp, Homo sapiens
  Payload ID: 2716
  Gene Symbol: CENPW
  Gene Name: centromere protein W
  Uniprot ID: Q5EE01
  ENST ID: ENST00000368325
  CDS Start-End: 101-412
atacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtgagattccatcccttctcgggctgggaatggggcacgggagaggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataagtga

SEQ ID NO: 116413 - DNA, 443 bp, Homo sapiens
  Payload ID: 2716
  Gene Symbol: CENPW
  Gene Name: centromere protein W
  ENST ID: ENST00000368326
  CDS Start-End: 101-304
atacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattgaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataagtga

SEQ ID NO: 116414 - DNA, 750 bp, Homo sapiens
  Payload ID: 2716
  Gene Symbol: CENPW
  Gene Name: centromere protein W
  Uniprot ID: Q5EE01
  ENST ID: ENST00000368328
  CDS Start-End: 101-367
atacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataagtgatgtgtgtgtttgtattttttttctggcatgaaatatctcaagtaaatgcataggactatttaacccttttatgggaattactattatttttattttaaatgtcctctagttcagtttgcttttgttttgttgctgctgcaaatattttatgtatcaaaaatgaaatcttactatattaaatactttgaaaatgtacttcttagaattaagtttatatatatttagatttagccacagttaactatggaatttaatctctgaagaaag

SEQ ID NO: 116415 - DNA, 1121 bp, Homo sapiens
  Payload ID: 2717
  Gene Symbol: CEP104
  Gene Name: centrosomal protein 104kDa
  Uniprot ID: O60308
  ENST ID: ENST00000378223
  CDS Start-End: 341-1075
cccagggctgggcttggttgtcatgagagtggaggctgcggccggggctatgggcagaggtggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacccagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacgtacgccagcagtgtaagaaccgggggtgaatccacttttggggagctaaagggccccgctgtgccatcctcggtcaccctctctgtcctgggcacctctttgggacagtggttcccttgccacctgcctgctgtggatgacaatgaggggactccattccagaggtgcctggtctaaaggaaagaagggaagggctgccatagttgccgcagtgagaaaaaaa

SEQ ID NO: 116416 - DNA, 6424 bp, Homo sapiens
  Payload ID: 2717
  Gene Symbol: CEP104
  Gene Name: centrosomal protein 104kDa
  Uniprot ID: O60308
  ENST ID: ENST00000378230
  CDS Start-End: 326-3103
ggttgtcatgagagtggaggctgcggccggggctatgggcagaggtggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacccagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacgtacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgaacgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgatgcgaagaccttttgatttgcccctccagcccctcgctcgttctggcagtccttgccaccaaaagccaatgccctcactaccacaactggaagaaagaggaacagaaaaccagtttgcagaacctttccttcaggaaaagccttcatcatattctctaactatttctcctcagcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccgggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcagtgttgtttgtctgcttgtttgcgacggagtctcactgtgtcgcccgggctgcagtgcaatggcgtgatcttggctcacagtaacctccacctcctgggttcaagcaattctcctgcctcagcctccctagtagctgggattacaggtgcacaccaccatgctcggctaattttttctatttttagtagagatggggtttcaccatgttggccaggctggtctcgaactcgtgacctcataatctgcccaccttggcctcccaaagtgctgggattacaggcgtgagccaccacgcccaggttaaatgtgtttataaggagagaggaggccaggcgcggtggctcacgctgtaatcccagcactttgggaggccgaggcgggcggaccacctgaggtcaggagttcgagaccagcctggccaacatggtgaaaccccatctctactaaaaatacaaaaatgagccaggcgtggtggcctgtagtcccagctacttgagaggctgaggcaggaaaattgcttgaacccgggaggtggaggttgcattgagcccacatcatgccattgcactccagcccaggcgacagagcgagactccgtctcgaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatatacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctcggcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgttt

SEQ ID NO: 116417 - DNA, 918 bp, Homo sapiens
  Payload ID: 2717
  Gene Symbol: CEP104
  Gene Name: centrosomal protein 104kDa
  ENST ID: ENST00000428079
  CDS Start-End: 321-918
tcatgagagtggaggctgcggccggggctatgggcagaggtggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacccagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacgtacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgaacgccttgggaggtatgaggtagagaaac

SEQ ID NO: 116418 - DNA, 683 bp, Homo sapiens
  Payload ID: 2717
  Gene Symbol: CEP104
  Gene Name: centrosomal protein 104kDa
  ENST ID: ENST00000438539
  CDS Start-End: 1-572
ggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccaggtgagggacagcgccgctgagcaggtgtagtctgcatccctccattttgacttattcaaaaaagcatccccgtccagggcaacatggcaagaccccatccctttaaaagcaaaataaagcatccaagcctg

SEQ ID NO: 116419 - DNA, 430 bp, Homo sapiens
  Payload ID: 2717
  Gene Symbol: CEP104
  Gene Name: centrosomal protein 104kDa
  ENST ID: ENST00000443466
  CDS Start-End: 1-430
cgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcct

SEQ ID NO: 116420 - DNA, 926 bp, Homo sapiens
  Payload ID: 2717
  Gene Symbol: CEP104
  Gene Name: centrosomal protein 104kDa
  ENST ID: ENST00000461667
  CDS Start-End: 1-558
gcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggtgaggggcctggggagaagggaccagtgaagtaggtgacacacctgtggatggcagtggtggtgacagtggtggtgtcagtgcgggaccatagccacagagtacagtacatgagtgttcagggaggggacagcgtctagtgagccctgtctgagcagtcgttccgtttacctacgtgttcacatgatttccttccgtacatttatgaatggtttatcgaggagcctcaactcactgaggcccagcctgtgtcactgggatacagcatgaaatggttttattttgttctggtcattgcctttatccagataatgagaccctcagtgacatcttgcccagattctgtaacactgcggtcccttttgcctaataaaacccagccctatttggttaaacga

SEQ ID NO: 116421 - DNA, 1035 bp, Homo sapiens
  Payload ID: 2718
  Gene Symbol: CEP112
  Gene Name: centrosomal protein 112kDa
  Uniprot ID: Q8N8E3
  ENST ID: ENST00000317442
  CDS Start-End: 245-880
attagctgacatcaggaactgagccaggcagtgtggttgtgatgtcactatctcacctcacccccacctaagagattgtggtggggaatctcagacactctaaccctctgggcccaagtcacctttctatcaggggagggaggctgtgctctcactggcttcttgttagaagttctgcctgccctacagcctgcactgagggctctcatcactgcttctgagatcttaatgggggtcaacgaagatgtgggcttctctgagtttagaccatccatctgccaaggaaaaccaagccctgagactgatagagatgagagaagagaatggtaatgtccccaagacagagcaggcaggaagtttgaagcctctgagggatacaggaaaatctaacctcaaagagaagaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcataca

SEQ ID NO: 116422 - DNA, 3517 bp, Homo sapiens
  Payload ID: 2718
  Gene Symbol: CEP112
  Gene Name: centrosomal protein 112kDa
  Uniprot ID: Q8N8E3
  ENST ID: ENST00000392769
  CDS Start-End: 220-3087
gggcccgttctccgggcctggggggcgcgcgcccctggggtcccggcgctgcccgctgtggtgtccccggcaggcagagcgcgatccaggccgggacgacttgggaaagttctaagtaaagtttgatcagccggtttgatcggtctgacgtggtccaagagtctgacccaagggtttgcgactgggagaggaaatctgtgtcctggacaagattggattatggaagtgggaagtgaagaagaaaaatgggagaagctggatgcagaatttgatcactttgtggttgatatgaagccctttgttctaaaattacctcataggacagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatgtccatctattttgatgaaccaaatccagcacgagcaaaaggttcaagcccagagggattaccagcctgggtactgggtgagctggagacaagtgaacacaaattaaatgaatcatggaaactctcttctggagaagataacactttagtacagtcgccaactgatgtctacagcagggaacagtacactgggaagctccgagtgagatcacactccttgagtccaactcacagagaagatggacaaaatattaccccaaagatttgtgaagtttattcgaaaaaatctcctgtttctttggatgatagtgacattgaagctcgccttaatagttggaatcttgggatagaaaatcctcgatacctgagacagaagcctatcccagtttctctgatgacaccgaaattcagcctgagaaaatccagcagtttccatgatgatcattttctctctcgaatacgtgagaaagagctggacatgaaaacaaaaatgatggaagctaaatttcatgaagaaaagcttaaactgcaacagaaacatgatgctgatgttcagaagattttagaaagaaagaataatgaaatagaagaactgaaaactttatacaggagtaaacaacatgaaactgaagagactattagaaagcttgaaaagaaagttcagacactgatacgtgactgtcaagttatcagagagactaaagaagaccagattgcagagctgaaaaagatatgtgaacaaagtacggaatctctaaataatgactgggaaaaaaagcttcacaatgctgtagcagaaatggaacaggaaaagtttgatcttcaaaagcaacacactgaaaacattcaagaattgcttgaggatacaaatgtgcgtctgaataaaatggagagtgaatacatggcgcaaacacagtccacaaaccacatgatcaaagaactggaggcccgtgtccagcagctgactggagaagcagagaacagtaatttacagaggcagaaattaattcaagaaaaagcagaacttgaaagatgttaccagataacgtgtagtgaattacaagaagtaaaggcaaggcgtaacacactgcataaagagaaggaccatcttgtaaatgattatgagcaaaacatgaaactgttacaaaccaaatatgatgctgatataaaccttctaaaacaagaacatgctctttcagcttctaaggcatctagtatgattgaagaattagagcagaatgtctgtcaattaaaacagcagttacaggaatcagaacttcaaagaaagcaacaactaagggatcaagaaaataagtttcagatggagaaaagtcatttaaaacacatctatgaaaaaaaggctcatgacttgcagagtgaacttgataaaggaaaagaagatactcaaaagaaaattcataaatttgaggaagctttgaaggaaaaagaggagcagctaactcgtgtgactgaagttcagaggttgcaggcccagcaggcagatgccgctctggaagagtttaagcggcaggtggaactgaactcagagaaagtctatgctgaaatgaaagagcagatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattattttgtactt

SEQ ID NO: 116423 - DNA, 2847 bp, Homo sapiens
  Payload ID: 2718
  Gene Symbol: CEP112
  Gene Name: centrosomal protein 112kDa
  ENST ID: ENST00000537949
  CDS Start-End: 48-2789
ggtttgcgactgggagaggaaatctgtgtcctggacaagattggattatggaagtgggaagtgaagaagaaaaatgggagaagctggatgcagaatttgatcactttgtggttgatatgaagccctttgttctaaaattacctcataggacagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatgtccatctattttgatgaaccaaatccagcacgagcaaaaggttcaagcccagagggattaccagcctgggtactgggtgagctggagacaagtgaacacaaattaaatgaatcatggaaactctcttctggagaagataacactttagtacagtcgccaactgatgtctacagcagggaacagtacactgggaagctccgagtgagatcacactccttgagtccaactcacagagaagatggacaaaatattaccccaaagatttgtgaagtttattcgaaaaaatctcctgtttctttggatgatagtgacattgaagctcgccttaatagttggaatcttgggctggacatgaaaacaaaaatgatggaagctaaatttcatgaagaaaagcttaaactgcaacagaaacatgatgctgatgttcagaagattttagaaagaaagaataatgaaatagaagaactgaaaactttatacaggagtaaacaacatgaaactgaagagactattagaaagcttgaaaagaaagttcagacactgatacgtgactgtcaagttatcagagagactaaagaagaccagattgcagagctgaaaaagatatgtgaacaaagtacggaatctctaaataatgactgggaaaaaaagcttcacaatgctgtagcagaaatggaacaggaaaagtttgatcttcaaaagcaacacactgaaaacattcaagaattgcttgaggatacaaatgtgcgtctgaataaaatggagagtgaatacatggcgcaaacacagtccacaaaccacatgatcaaagaactggaggcccgtgtccagcagctgactggagaagcagagaacagtaatttacagaggcagaaattaattcaagaaaaagcagaacttgaaagatgttaccagataacgtgtagtgaattacaagaagtaaaggcaaggcgtaacacactgcataaagagaaggaccatcttgtaaatgattatgagcaaaacatgaaactgttacaaaccaaatatgatgctgatataaaccttctaaaacaagaacatgctctttcagcttctaaggcatctagtatgattgaagaattagagcagaatgtctgtcaattaaaacagcagttacaggaatcagaacttcaaagaaagcaacaactaagggatcaagaaaataagtttcagatggagaaaagtcatttaaaacacatctatgaaaaaaaggctcatgacttgcagagtgaacttgataaaggaaaagaagatactcaaaagaaaattcataaatttgaggaagctttgaaggaaaaagaggagcagctaactcgtgtgactgaagttcagaggttgcaggcccagcaggcagatgccgctctggaagagtttaagcggcaggtggaactgaactcagagaaagtctatgctgaaatgaaagagcagatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagc

SEQ ID NO: 116424 - DNA, 3392 bp, Homo sapiens
  Payload ID: 2718
  Gene Symbol: CEP112
  Gene Name: centrosomal protein 112kDa
  Uniprot ID: Q8N8E3
  ENST ID: ENST00000535342
  CDS Start-End: 92-2959
tttgaaaccgtttggcaggggcggcggtggcggcggcgttggcggcagcggccgagcggaaagcttgcgtgtggtggtgccagattggattatggaagtgggaagtgaagaagaaaaatgggagaagctggatgcagaatttgatcactttgtggttgatatgaagccctttgttctaaaattacctcataggacagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatgtccatctattttgatgaaccaaatccagcacgagcaaaaggttcaagcccagagggattaccagcctgggtactgggtgagctggagacaagtgaacacaaattaaatgaatcatggaaactctcttctggagaagataacactttagtacagtcgccaactgatgtctacagcagggaacagtacactgggaagctccgagtgagatcacactccttgagtccaactcacagagaagatggacaaaatattaccccaaagatttgtgaagtttattcgaaaaaatctcctgtttctttggatgatagtgacattgaagctcgccttaatagttggaatcttgggatagaaaatcctcgatacctgagacagaagcctatcccagtttctctgatgacaccgaaattcagcctgagaaaatccagcagtttccatgatgatcattttctctctcgaatacgtgagaaagagctggacatgaaaacaaaaatgatggaagctaaatttcatgaagaaaagcttaaactgcaacagaaacatgatgctgatgttcagaagattttagaaagaaagaataatgaaatagaagaactgaaaactttatacaggagtaaacaacatgaaactgaagagactattagaaagcttgaaaagaaagttcagacactgatacgtgactgtcaagttatcagagagactaaagaagaccagattgcagagctgaaaaagatatgtgaacaaagtacggaatctctaaataatgactgggaaaaaaagcttcacaatgctgtagcagaaatggaacaggaaaagtttgatcttcaaaagcaacacactgaaaacattcaagaattgcttgaggatacaaatgtgcgtctgaataaaatggagagtgaatacatggcgcaaacacagtccacaaaccacatgatcaaagaactggaggcccgtgtccagcagctgactggagaagcagagaacagtaatttacagaggcagaaattaattcaagaaaaagcagaacttgaaagatgttaccagataacgtgtagtgaattacaagaagtaaaggcaaggcgtaacacactgcataaagagaaggaccatcttgtaaatgattatgagcaaaacatgaaactgttacaaaccaaatatgatgctgatataaaccttctaaaacaagaacatgctctttcagcttctaaggcatctagtatgattgaagaattagagcagaatgtctgtcaattaaaacagcagttacaggaatcagaacttcaaagaaagcaacaactaagggatcaagaaaataagtttcagatggagaaaagtcatttaaaacacatctatgaaaaaaaggctcatgacttgcagagtgaacttgataaaggaaaagaagatactcaaaagaaaattcataaatttgaggaagctttgaaggaaaaagaggagcagctaactcgtgtgactgaagttcagaggttgcaggcccagcaggcagatgccgctctggaagagtttaagcggcaggtggaactgaactcagagaaagtctatgctgaaatgaaagagcagatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattattttgtacttacc

SEQ ID NO: 116425 - DNA, 547 bp, Homo sapiens
  Payload ID: 2718
  Gene Symbol: CEP112
  Gene Name: centrosomal protein 112kDa
  ENST ID: ENST00000581734
  CDS Start-End: 1-162
caaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagatgaaatgccgatgaagtgagcccaggtctacgtggttgtatatgatctgcttcatgcaaactccagcctacataatagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattc

SEQ ID NO: 116426 - DNA, 637 bp, Homo sapiens
  Payload ID: 2718
  Gene Symbol: CEP112
  Gene Name: centrosomal protein 112kDa
  ENST ID: ENST00000585168
  CDS Start-End: 1-140
gattgatgccagcatccctaagacaagaacttgaagacaccatttcctccctaaaatcacaggttaattttctgcaaaagagagcttccatccttcaggaagaactgactacatatcaaggcagaaggtacagcccataagcaggtgtcttgtctcctgattagtttgtgttgtgtcacctgtgagcctccttgtctggcctttgtctttattaaaatgcttggatataatacaagttttgaaaaagacttgtttttagtaagtagcatgtctttaagaagtcaccccccttctcatcccagtgcttagtctgtactatcaaaacaagatgagagaatctgccgggcacagtggctcactcctgtaatcccagcactttgggaggccaaggcaggaggatcacctgaggtcaggagttcaagaccagcctggccaacttggtaaaacgttgtctctactaaaaatacaaaaattagctaggtatggtggcacacgcctataatcccagctactcaggaggctgaggcaggagaattgcttgaacctgggaggtggaggttgcagtgagctgagatcacaccactgcattccagcctgggcagcagagtaagactctgtctccaaaaaaaaaaacaaa

SEQ ID NO: 116427 - DNA, 1902 bp, Homo sapiens
  Payload ID: 2718
  Gene Symbol: CEP112
  Gene Name: centrosomal protein 112kDa
  ENST ID: ENST00000583358
  CDS Start-End: 206-1902
ggcctggggggcgcgcgcccctggggtcccggcgctgcccgctgtggtgtccccggcaggcagagcgcgatccaggccgggacgacttgggaaagttctaagtaaagtttgatcagccggtttgatcggtctgacgtggtccaagagtctgacccaagggtttgcgactgggagaggaaatctgtgtcctggacaagattggattatggaagtgggaagtgaagaagaaaaatgggagaagctggatgcagaatttgatcactttgtggttgatatgaagccctttgttctaaaattacctcataggacagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatgtccatctattttgatgaaccaaatccagcacgagcaaaaggttcaagcccagagggattaccagcctgggtactgggtgagctggagacaagtgaacacaaattaaatgaatcatggaaactctcttctggagaagataacactttagtacagtcgccaactgatgtctacagcagggaacagtacactgggaagctccgagtgagatcacactccttgagtccaactcacagagaagatggacaaaatattaccccaaagatttgtgaagtttattcgaaaaaatctcctgtttctttggatgatagtgacattgaagctcgccttaatagttggaatcttgggatagaaaatcctcgatacctgagacagaagcctatcccagtttctctgatgacaccgaaattcagcctgagaaaatccagcagtttccatgatgatcattttctctctcgaatacgtgagaaagagctggacatgaaaacaaaaatgatggaagctaaatttcatgaagaaaagcttaaactgcaacagaaacatgatgctgatgttcagaagattttagaaagaaagaataatgaaatagaagaactgaaaactttatacaggagtaaacaacatgaaactgaagagactattagaaagcttgaaaagaaagttcagacactgatacgtgactgtcaagttatcagagagactaaagaagaccagattgcagagctgaaaaagatatgtgaacaaagtacggaatctctaaataatgactgggaaaaaaagcttcacaatgctgtagcagaaatggaacaggaaaagtttgatcttcaaaagcaacacactgaaaacattcaagaattgcttgaggatacaaatgtgcgtctgaataaaatggagagtgaatacatggcgcaaacacagtccacaaaccacatgatcaaagaactggaggcccgtgtccagcagctgactggagaagcagagaacagtaatttacagaggcagaaattaattcaagaaaaagcagaacttgaaagatgttaccagataacgtgtagtgaattacaagaagtaaaggcaaggcgtaacacactgcataaagagaaggaccatcttgtaaatgattatgagcaaaacatgaaactgttacaaaccaaatatgatgctgatataaaccttctaaaacaagaacatgctctttcagcttctaaggcatctagtatgattgaagaattagagcagaatgtctgtcaattaaaacagcagttacaggaatcagaacttcaaagaaagcaacaactaagggatcaagaaaataagtttcagatggagaaaagtcatttaaaacacatctatgaaaaaaaggctcatgacttgcagagtgaacttgataaaggaaaagaaga

SEQ ID NO: 116428 - DNA, 556 bp, Homo sapiens
  Payload ID: 2718
  Gene Symbol: CEP112
  Gene Name: centrosomal protein 112kDa
  ENST ID: ENST00000577322
  CDS Start-End: 515-556
atatagcaatcccccttaatcttgaggaatacattccaagacccccagaggctgcctgaaacagctgatagtactaaaacctatatatgctctgtcttttcctatacatacacactgatgattaaatttagtttatcagttaggtacagtatgagattaacagcaatagctaataataaaatagaacaattataacaatataatgtaacaaaaattgtgtgaaagtaatttccctctttctttcaaaatatcttattgtattgtgctcacctatttttggactgcattcgagtgtaggtaactgaaacagaggaaagcgaaaccatggataagtggagactgttgcatttattccagggagctgtgttaggagaagggagtatgatatataaattatgcattccgtgttcacttattgttctagggccttcaacctttcctagtcctggaacggcagaggtgtgctctttggattagaaagctgtgcgaaccttcaggaacaggtgcaggaataatggggaggaagaatcggaacctgtatgcaaaattgttattg

SEQ ID NO: 116429 - DNA, 473 bp, Homo sapiens
  Payload ID: 2718
  Gene Symbol: CEP112
  Gene Name: centrosomal protein 112kDa
  ENST ID: ENST00000581739
  CDS Start-End: 1-318
gccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcataca

SEQ ID NO: 116430 - DNA, 4900 bp, Homo sapiens
  Payload ID: 2719
  Gene Symbol: CEP120
  Gene Name: centrosomal protein 120kDa
  Uniprot ID: Q8N960
  ENST ID: ENST00000306467
  CDS Start-End: 306-3266
agcggctacgcaggcggcaaaaggtcctcgggtggcgggcttgtctctgcttgcagactggcagggctgcagcgtggctttttccttgagtcggggcacagttaggatctgggctggcggcccgaggcagaggagccgggcgcgctgcagcagacggcggtgggacctggctgcggagcggggtccgggcatcagggaccgggggcgggcagtgggggtcccgccgggggtcccggattacccgcgactcaactggacctcacttccccccagccgccttcgcccccggaccgctcaccgcaaccatggtctccaaatccgaccaattgctcatcgtcgtgtccatcctagaaggtcggcatttccccaaacgtccaaagcatatgcttgtagtggaagcaaagtttgatggagaacagttggctactgatcctgtggaccacactgaccagccagaatttgctactgagttagcttgggaaattgacaggaaagcgcttcatcagcacaggctacagcgtactcctatcaaactccaatgttttgccttggatcctgtaacttcagccaaggaaaccataggttacatcgttctggatttaagaaccgctcaagaaacaaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccagtctttaattgaattaaagacccagaatgaacatgagccagagcattcaaagaagaaagttttaacccccataaaggagaagacacttactgggccaaaatcaccaacagtgtcccctgttccatctcacaaccagtcacctccaacaaaagatgatgcaacagaaagtgaagtggaaagtttacagtatgataaggacaccaaaccaaatccaaaagccagttcttctgtacctgcttcactggcccagctagtgactacatccaatgcttcagaagtagcttcaggacagaagattgctgtaccagcaacatcacatcatttttgcttttcaatagacttaaggagtatacatgccttggagattggttttccaatcaactgtatattaaggtactcatatccattctttggaagtgcagctcctattatgactaatcctcctgtagaagttcggaaaaacatggaagtttttcttccccagtcttactgtgcatttgattttgcaactatgcctcatcagctgcaagacaccttcttaaggattccattactggttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaacctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactagctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaatggatgtgtagtttattttgccttttgtaaagctcttttggctattgtaacttaacaaataaaatcataattgtgtgcatctctga

SEQ ID NO: 116431 - DNA, 4629 bp, Homo sapiens
  Payload ID: 2719
  Gene Symbol: CEP120
  Gene Name: centrosomal protein 120kDa
  Uniprot ID: Q8N960
  ENST ID: ENST00000306481
  CDS Start-End: 114-2996
tttacagcagtagtgcgcttgcgcagctggtcccacaccaagtcgcccgcctctcctcgtccggctagcagagggcgctgtgaggtcggcatttccccaaacgtccaaagcatatgcttgtagtggaagcaaagtttgatggagaacagttggctactgatcctgtggaccacactgaccagccagaatttgctactgagttagcttgggaaattgacaggaaagcgcttcatcagcacaggctacagcgtactcctatcaaactccaatgttttgccttggatcctgtaacttcagccaaggaaaccataggttacatcgttctggatttaagaaccgctcaagaaacaaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccagtctttaattgaattaaagacccagaatgaacatgagccagagcattcaaagaagaaagttttaacccccataaaggagaagacacttactgggccaaaatcaccaacagtgtcccctgttccatctcacaaccagtcacctccaacaaaagatgatgcaacagaaagtgaagtggaaagtttacagtatgataaggacaccaaaccaaatccaaaagccagttcttctgtacctgcttcactggcccagctagtgactacatccaatgcttcagaagtagcttcaggacagaagattgctgtaccagcaacatcacatcatttttgcttttcaatagacttaaggagtatacatgccttggagattggttttccaatcaactgtatattaaggtactcatatccattctttggaagtgcagctcctattatgactaatcctcctgtagaagttcggaaaaacatggaagtttttcttccccagtcttactgtgcatttgattttgcaactatgcctcatcagctgcaagacaccttcttaaggattccattactggttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaacctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactagctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaatggatgtgtagtttattttgccttttgtaaagctcttttggctattgtaacttaacaaataaaatcataattgtgtgcatctctg

SEQ ID NO: 116432 - DNA, 4710 bp, Homo sapiens
  Payload ID: 2719
  Gene Symbol: CEP120
  Gene Name: centrosomal protein 120kDa
  Uniprot ID: Q8N960
  ENST ID: ENST00000328236
  CDS Start-End: 117-3077
tttacagcagtagtgcgcttgcgcagctggtcccacaccaagtcgcccgcctctcctcgtccggctagcagagggcgctgtgagccgccttcgcccccggaccgctcaccgcaaccatggtctccaaatccgaccaattgctcatcgtcgtgtccatcctagaaggtcggcatttccccaaacgtccaaagcatatgcttgtagtggaagcaaagtttgatggagaacagttggctactgatcctgtggaccacactgaccagccagaatttgctactgagttagcttgggaaattgacaggaaagcgcttcatcagcacaggctacagcgtactcctatcaaactccaatgttttgccttggatcctgtaacttcagccaaggaaaccataggttacatcgttctggatttaagaaccgctcaagaaacaaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccagtctttaattgaattaaagacccagaatgaacatgagccagagcattcaaagaagaaagttttaacccccataaaggagaagacacttactgggccaaaatcaccaacagtgtcccctgttccatctcacaaccagtcacctccaacaaaagatgatgcaacagaaagtgaagtggaaagtttacagtatgataaggacaccaaaccaaatccaaaagccagttcttctgtacctgcttcactggcccagctagtgactacatccaatgcttcagaagtagcttcaggacagaagattgctgtaccagcaacatcacatcatttttgcttttcaatagacttaaggagtatacatgccttggagattggttttccaatcaactgtatattaaggtactcatatccattctttggaagtgcagctcctattatgactaatcctcctgtagaagttcggaaaaacatggaagtttttcttccccagtcttactgtgcatttgattttgcaactatgcctcatcagctgcaagacaccttcttaaggattccattactggttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaacctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactagctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaatggatgtgtagtttattttgccttttgtaaagctcttttggctattgtaacttaacaaataaaatcataattgtgtgcatctctg

SEQ ID NO: 116433 - DNA, 2645 bp, Homo sapiens
  Payload ID: 2719
  Gene Symbol: CEP120
  Gene Name: centrosomal protein 120kDa
  ENST ID: ENST00000508442
  CDS Start-End: 114-2645
tttacagcagtagtgcgcttgcgcagctggtcccacaccaagtcgcccgcctctcctcgtccggctagcagagggcgctgtgaggtcggcatttccccaaacgtccaaagcatatgcttgtagtggaagcaaagtttgatggagaacagttggctactgatcctgtggaccacactgaccagccagaatttgctactgagttagcttgggaaattgacaggaaagcgcttcatcagcacaggctacagcgtactcctatcaaactccaatgttttgccttggatcctgtaacttcagccaaggaaaccataggttacatcgttctggatttaagaaccgctcaagaaacaaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccagtctttaattgaattaaagacccagaatgaacatgagccagagcattcaaagaagaaagttttaacccccataaaggagaagacacttactgggccaaaatcaccaacagtgtcccctgttccatctcacaaccagtcacctccaacaaaagatgatgcaacagaaagtgaagtggaaagtttacagtatgataaggacaccaaaccaaatccaaaagccagttcttctgtacctgcttcactggcccagctagtgactacatccaatgcttcagaagtagcttcaggacagaagattgctgtaccagcaacatcacatcatttttgcttttcaatagacttaaggagtatacatgccttggagattggttttccaatcaactgtatattaaggtactcatatccattctttggaagtgcagctcctattatgactaatcctcctgtagaagttcggaaaaacatggaagtttttcttccccagtcttactgtgcatttgattttgcaactatgcctcatcagctgcaagacaccttcttaaggattccattactggttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtctt

SEQ ID NO: 116434 - DNA, 3973 bp, Homo sapiens
  Payload ID: 2719
  Gene Symbol: CEP120
  Gene Name: centrosomal protein 120kDa
  Uniprot ID: Q8N960
  ENST ID: ENST00000513565
  CDS Start-End: 347-1489
gggcgcggcggcggccgctgcggccgcccgggcgtttgaaaagcggctacgcaggcggcaaaaggtcctcgggtggcgggcttgtctctgcttgcagactggcagggctgcagcgtggctttttccttgagtcggggcacagttaggatctgggctggcggcccgaggcagaggagccgggcgcgctgcagcagacggcggtgggacctggctgcggagcggggtccgggcatcagggaccgggggcgggcagtgggggtcccgccgggggtcccggattacccgcgactcaactggacctcacttccccccagccgccttcgcccccggaccgctcaccgcaaccatggtctccaaatccgaccaattgctcatcgtcgtgtccatcctagaaggtcggcatttccccaaacgtccaaagcatatgcttgtagtggaagcaaagtttgatggagaacagttggctactgatcctgtggaccacactgaccagccagaatttgctactgagttagcttgggaaattgacaggaaagcgcttcatcagcacaggctacagcgtactcctatcaaactccaatgttttgccttggatcctgtaacttcagccaaggaaaccataggttacatcgttctggatttaagaaccgctcaagaaacaaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccaggatgcattttggtattcagctctggatatcatatttcctctgttcatcttcctttttctggtcctagatgctataaggaaatttgcaaattacgaagaaaaatagactaggaatatccaaactgggaaaggaagcttatatttttaaaaaacaatgccaagttttttgcttaattatgaaggaaagttctttgcaaattatactttatttaaaaattgtttttagtctttaattgaattaaagacccagaatgaacatgagccagagcattcaaagaagaaagttttaacccccataaaggagaagacacttactgggccaaaatcaccaacagtgtcccctgttccatctcacaaccagtcacctccaacaaaagatgatgcaacagaaagtgaagtggaaagtttacagtatgataaggacaccaaaccaaatccaaaagccagttcttctgtacctgcttcactggcccagctagtgactacatccaatgcttcagaagtagcttcaggacagaagattgctgtaccagcaacatcacatcatttttgcttttcaatagacttaaggagtatacatgccttggagattggttttccaatcaactgtatattaaggtgtgatttgattttgtttcaaagtattattttctgaagagaaaggactttcctgtgtttggggaattgcagagagaaatgtcaccaaagaagttataacatttgttaaatcagtggactaaaagggggtactcatatccattctttggaagtgcagctcctattatgactaatcctcctgtagaagttcggaaaaacatggaagtttttcttccccagtcttactgtgcatttgattttgcaactatgcctcatcagctgcaagacaccttcttaaggattccattactggttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagccaaagaagacagtttggtgtatttttgtccagatatgtttttctttttaaataactttaaaatgaaatatacatttcaaagaaggttcttctactctttccacctgcctcctggtttaagaaacagagcattatgatgaatgctttggaagccctctgtgtccctttctcaactgtgtcttctctttccagagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaacctcaaaagtgaggaaaatggatgttttaaaatggtattttcaattttttataagcaaaa

SEQ ID NO: 116435 - DNA, 4720 bp, Homo sapiens
  Payload ID: 2719
  Gene Symbol: CEP120
  Gene Name: centrosomal protein 120kDa
  ENST ID: ENST00000508138
  CDS Start-End: 69-671
gcctctcctcgtccggctagcagagggcgctgtgagccgccttcgcccccggaccgctcaccgcaaccatggtctccaaatccgaccaattgctcatcgtcgtgtccatcctagaaggtcggcatttccccaaacgtccaaagcatatgcttgtagtggaagcaaagtttgatggagaacagttggctactgatcctgtggaccacactgaccagccagaatttgctactgagttagcttgggaaattgacaggaaagcgcttcatcagcacaggctacagcgtactcctatcaaactccaatgttttgccttggatcctgtaacttcagccaaggaaaccataggttacatcgttctggatttaagaaccgctcaagaaacaaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagaaatatcatcgaacagatgccacgttcttcccattgcatcttatcaggcacagcaagatgttccaagctcatcttgtgcttactctgtctcagctctggattcagccatttctctaaggagccctgcttcctttcggtaaagaatgatttttagaagccaagatctaggtgctagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccagtctttaattgaattaaagacccagaatgaacatgagccagagcattcaaagaagaaagttttaacccccataaaggagaagacacttactgggccaaaatcaccaacagtgtcccctgttccatctcacaaccagtcacctccaacaaaagatgatgcaacagaaagtgaagtggaaagtttacagtatgataaggacaccaaaccaaatccaaaagccagttcttctgtacctgcttcactggcccagctagtgactacatccaatgcttcagaagtagcttcaggacagaagattgctgtaccagcaacatcacatcatttttgcttttcaatagacttaaggagtatacatgccttggagattggttttccaatcaactgtatattaaggtactcatatccattctttggaagtgcagctcctattatgactaatcctcctgtagaagttcggaaaaacatggaagtttttcttccccagtcttactgtgcatttgattttgcaactatgcctcatcagctgcaagacaccttcttaaggattccattactggttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaacctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactagctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctct

SEQ ID NO: 116436 - DNA, 578 bp, Homo sapiens
  Payload ID: 2719
  Gene Symbol: CEP120
  Gene Name: centrosomal protein 120kDa
  ENST ID: ENST00000510582
  CDS Start-End: 83-578
acaccaagtcgcccgcctctcctcgtccggctagcagagggcgctgtgagccgccttcgcccccggaccgctcaccgcaaccatggtctccaaatccgaccaattgctcatcgtcgtgtccatcctagaaggtcggcatttccccaaacgtccaaagcatatgcttgtagtggaagcaaagtttgatggagaacagttggctactgatcctgtggaccacactgaccagccagaatttgctactgagttagcttgggaaattgacaggaaagcgcttcatcagcacaggctacagcgtactcctatcaaactccaatgttttgccttggatcctgtaacttcagccaaggaaaccataggttacatcgttctggatttaagaaccgctcaagaaacaaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtacctgccatcctggctggacttgaccccaggg

SEQ ID NO: 116437 - DNA, 606 bp, Homo sapiens
  Payload ID: 2719
  Gene Symbol: CEP120
  Gene Name: centrosomal protein 120kDa
  ENST ID: ENST00000515110
  CDS Start-End: 327-539
cggccgcccgggcgtttgaaaagcggctacgcaggcggcaaaaggtcctcgggtggcgggcttgtctctgcttgcagactggcagggctgcagcgtggctttttccttgagtcggggcacagttaggatctgggctggcggcccgaggcagaggagccgggcgcgctgcagcagacggcggtgggacctggctgcggagcggggtccgggcatcagggaccgggggcgggcagtgggggtcccgccgggggtcccggattacccgcgactcaactggacctcacttccccccagccgccttcgcccccggaccgctcaccgcaaccatggtctccaaatccgaccaattgctcatcgtcgtgtccatcctagaaggcttcctgcgattccagaagtgttccggaggcaattccctttacacgtcttgctggaggactcaggggactacagttcttaagagggtgtattatacattccttaaaaggtcggcatttccccaaacgtccaaagcatatgcttgtagtggaagcaaagtttgatggagaacagttggctactgatcctgtggaccacactgaccagccagaatttgctactgagttagct

SEQ ID NO: 116438 - DNA, 7039 bp, Homo sapiens
  Payload ID: 2720
  Gene Symbol: CEP126
  Gene Name: centrosomal protein 126kDa
  Uniprot ID: Q9P2H0
  ENST ID: ENST00000263468
  CDS Start-End: 271-3624
gtcggttgttgtcaagatggcggctgcagggttgctgccgccccatctgctattgcccggcgaggtcgccgctgcctcagctgccatcgccgctacaggcaccagtgccgctgcgcgggagctagggctgtcgaggccaacccttccgcgcccgtgacgcggggcctgagagacggagtgtagggaggggccgagcaggaggaggaggaagccggagctgccatgagggaggttctgggggcgagcagacaggcggcgctgaagtgaaggatgctggcggggaggcccggaacccggagcgcggtcggggaactgggcactgaatcatcggacaacctcgacagagcccccctcggccctcgggagagcggcgggcatcaccgacctggctcttacctagatatgaaaatccatctggagaaaaatttagaagaagagcgccagatattactgcagcaacaaaaaatatgtcgaaatcgagcacgtaaatattttgtggagtcaaatcggagaaaaaaagcttttgaggagaaacgaaaagaacaggaagaaaaagaacaccaaattagagaacaaatacttcaacaaagaaaacagaagtttgaagaagttactgaaaaattccagcgtgcccatgttcctctttcacagcggaggaaagcagtttcccgaaaaccagttcctccattagaagaggccctcaaacaaattcaggaatccaacttaaaatcagaagtaaaccttcccttttcccgtagaccaacaataaactggagagctatagattctgccttgccttccgcattatcaaaaaatgatcacaagcatcagaaacaactcttatccaaaatcaattgtgagaaagaaatgaatgaaaacatgagggcaaccttggctactagcaaaaatgtgttccagcttaaactggaggaaactcagaaactcctcgaagatcaacatctaagcaatttgcaaaaattttgtgatgaagttaatcagataaccaattctgaaaccctctcaagtatagacagtcttgaggctacagagcatgaagaaatatatttaacacttaataaggagcattccacatccatccagcggaataccatttccctcaaaccagcaaatatgcaatcaactaatctcagctgctttgatgaagataaactggcattctctaaaactcaacatataaataattggcttacaaatttagatgcttcaaatactcagaatgtcacagctttctcagatattttaagtaaatctaatgttctgccttcatgggaatattttaatagtaaagaacaaaatccatctcctttgaatggaacagtggaaagagccacaaatactgctaataattcagtaccctttgtatctagcccacccatgtttgtactagataaaaaatgtgaaaagacctctgaaactagcactatgaggacaactgactccacttctggagcattcaaaagagagagaccattagttactgagagcccaacatttaaatttagcaaatcccaaagcacttcagattctctaacccaggaagtggctacatttccagaccaagagaaatattctgaattaaatcaagaaaatggaactacttcaattcctacttcatgtgtaccagtggcaacgcctttagttttgccatctaatatacagtcagctagaccttcagcaaagaacagtatacacataaaagaaattgatgcagtgcagtgttctgataagttagatgaattgaaagatggtaaagaagaagagataaaatattttaattgcaataaggaagagttgcctttattttcagacagttttcaagatgcctatatacctcacaatcctgattcaaaagatgaaaaacaaaaattagctgaaacatcatccttgtctaatgtaacttctaattatgactttgttggccagcataagaaaatgaaatacaacatccatgagagaaatggtgtgagatttcttaaaagtattttaaagaaagaatctaaatatgaacatggttatcttaaggcattaattataaatcagagctttaagtttggaaatcaaaaagcagcagctatcagagatagtattgaattaacaaaggaaaaaggtgcagaaattccaaagaccattaaaaaactgaggtggtttgatgaaactagcaatatagaaaacaatgctgaaaacagtcattcactgaagaataaaacaggaacaactcaacagcattctcaacaattccacattcaaagtggtgctggaagcaacataattagtgtttctacttgtgctgtaaattctgctgatacaaagaagtccagggaggattctatctctgaaaatgttacgactttaggaggatctggagcagaccatatgcctttgaactgttttataccttcaggttataactttgctaaacatgcctggccagcctcaaaaaaagaagaaagtaaaatccctgtacatgatgattctaaaactaagcaaggtaagccacaaagaggtagagcaaaaataattagaaaaccaggatctgcaaaagtccaatcaggctttatatgtacaaacagaaaaggcgctgtcattcaaccacagtctgcaagcaaagtcaacatatttacacaagctcagggaaaattaattataccttgtcctcctcctcaatctacatcaaatattagaagtggtaaaaatatacaagtgtctcagtgtcaaccagtaactcctgaaaatcctcaaaacattattacacataactcttttaattcaaaacatgtgcttccaacagaacacagtttgaatcagtggaatcaggaaagtagttctccactctcaaatgcttgttctgacctagtcactgtgataccatcactgccatcatattgttcttcagagtgccaaactttcgcaaaaataaatcattcaaatggcactcaagcagttgcccggcaagatgcgacattatattgcacccaaagaagtcctgtttgtgaagaaagttatccgtctgtgactctaagaactgctgaagaagaatcagttcccttatggaaaagaggtcctaatgtcctgcatcaaaataagagggctacagggtctactgttatgagaagaaaacgaattgctgaaactaagcggagaaatattttagagcagaaaagacaaaaccctggatctgtaggacagaagtacagtgagcaaattaataattttggacaaagtgtcctgctaagttcaagtgagccaaaacaaactacaaggggtacttcttatattgaagaagtttcagatagtacttctgagtttttgatggctgaaaacttagtgaaagcatcagtgccggaggatgagattctgactgtcttgaatagcaaacagatacagaaatcaaatctacctttaaataaaactcaacaattcaacatctgcacactgtcagctgaagaacagaagatcctagagtcccttaatgatctcagtgaaagactacattatatacaagaatccatttgcaaaaacccatccatcaaaaatactttacaaataataccacttctggagaagagagaagatagaaccagcagctgcagagacaagagataattccagcagaatccgtctaagaagacctttcatgtacttccctaggactagatgcataccgttttgtgaaaaccagccataggaaaacatgtgagcaacaacccccatgaacatttgtcctaactcagattttgtgagcagtgaagtttaacagagcagtgacatttaacaaagcagtgaagtttaacagagttctgagaataccatgaaagacattatgcctgcctaaacaaaaagcaggacataacctagctctgaatacatgccacaaggatgaagcttgtgagtagagcaaacaaacgtttttccaaagaattcacagtgctcctttgcaatttatagatttcatgttgaaatatatgttaaataaaatttctgtttattgaacctctttattaaacctctaacttactgataagatgtttatgaagtatggcatattttgatttttttaattgtaataaatattcttaaagttaccacatcccacaaaatggcccttggtggcagcaatagagcaaaggttacctttttgtatggtgaagggaggccttcctatggctgtacaattacatcgattcttccaaatttcatatttcatacatggcactttggcataccgaaaaaacatgaaatttttcattaaaatgccatgaatcaagccagggccgttggcttatgcctgtaatcccagcactttgcaggccgaggtagacagatggcttgagctcaggagttcgtgaccagcctgggcaaccctgtctctacaaaaaatacaaaaattaaccaggcatggtggcatgcacctgtagtcccagctacttggggtgctgaggcgggaggattacttgagcccaggaggattacttcaacctgggaggttgaggctgcagtgagctgtgtttcgccactgcacaccagcctgggtgacagtgtgagacccagcctcaaaaaaaaaaaaaaaaaagtgatgaatcaaaattagaaattaagagttttaagaaaacatgtggccttttattaataacactactaaattttggttcctccatagaattagttttgaaacacttgatgtagtgagaaatgcattaacatgttgaatgcctaccatgtaccaaattttgtgcatatattttttatttaatctgaccagccacccaaaccatgggtatttttgtctccactttagagatgagaaactgagccaaggccacatagctacctacagtgacagaatcaaaattcaaactcaggtttatctagttccaaaacccatgttctttctgccacaccatgttagtagaaatggaaactattggatgaaatgaggaaaaacaggaaaagaattcactttttaaatgaagaaattagtgaaaaaattgacctaatgaaggaaacatttgtgctttcctatatttttaattttaagaataggatttcggaaggcgacagaaaatttagttcttagacatttaaatagaaagttgtgtgcccctatagaaaatatttgagaatttcttatactatcaagaaaaaattctgtgaattaagatgtaatttataaaataacatttcaatgggggtaaacaggccagaagagtgtgccaagttgtttgtgaatcattccaagcacctcagatgaaaactcacttttattaaaaaaaaaaaagacaagggtttatattcatatacactagtatatatgtacacagcagcatcctgcatgccaaagtagcttcaccgttagtaatccctcactttaatacctcttaggaaccaaagaatgcctctacaagcaaaaagatagttgaaaatagttaagatccaaagtcagaataggccaaaaaaaaaaaaaaaaaaagcctaaatagtaagctggtgaaacaagataagatttgcattttactagaacttgcacattatgatattgtccttttatgaaactgtcatatgaccagaattcttctgtaattctgcccatgactcctccagaattttagtagatacagggtgggttcattaagagtgataaaagtgggaagacataaagagcctttgtgaattaaagtggaagagaataacactttgcatgctataaacgtgaaaactaacatttttggccagacacagtggctcatgcatgtaattctagcactttggaggccaaggcaggaggactgcttgagcccaggagtttgagaccagcctgggcaatgtagcaagaccccatctctatataaaatataaaaatgttggctgtgcacggtagcttatgcctgtaatctcagcactttgggaggccaaggcaggcagatcatgaggtcaagagatcaagaccatcctggccaacatggtgaaaccctgtctctactaaaaatacaaaaatagctgggcatggtggcacgcacctctactcccagctactaggaggctgaggcaggagaatcgtttgaacccaggaggtagaggttgcagtgagctgagattgcaccactgcaccagcctggcaacagagcaagactccgtctcacaaaaatgaataaataaaataaaaataaaaatgttactttttaaaaagtaacttttttaataatataagaaagaaaaatgccctttcacactgaatcttcaagttctaaggaagaaaagagtctcctttcgaatgtgaagaagtaaatttagaggaaatcaaacaagcatcactttcctcagtggaaaaacttatgaaacttcttataagagagagtaatctcaggccggacatgctggctcatacctgtaatcccagaactttgggaggccgaggcaggtggatcatttgagctcaggaattcaagaccagcctgggtaatatggcaagagcccaactctactaaaaatacaaaaagaaaagaaaacagccaagcttggtggtatgtgcctgtggtcccagctactggggaggctgaggtgggaggatcgtttgagcctgggaggcagaggttgcagtgatcaggaattgtgccactgcactccaacctgagtgacagagcaacactctgtcttaaaagaaaaaaaaaaaagagagagatagtaatctcttgggcaaaaggtatcaaataattgaaagaaaagtttaaacacatttccgagaggcagggcaactaataactggtcagaaaaatttagacggtcttcattttaaaattggcatcaggaaggattaccatgaacttattttaaatccatattgtaccagaatgactatgtctgtgtttcttaggaatgttgaagctttttgtgaaaactgtactgtatacatatataaatatacacacacttacatgtatgtattttgatagatattacatggactaaattttgtcaatttcatgtaatttaccctttgcaataaaaatgattcattaaatat

SEQ ID NO: 116439 - DNA, 4533 bp, Homo sapiens
  Payload ID: 2720
  Gene Symbol: CEP126
  Gene Name: centrosomal protein 126kDa
  ENST ID: ENST00000532529
  CDS Start-End: 1-1298
gtgcccatgttcctctttcacagcggaggaaagcagtttcccgaaaaccagttcctccattagaagaggccctcaaacaaattcaggaatccaacttaaaatcagaagtaaaccttcccttttcccgtagaccaacaataaactggagatccattcctgcctgtccagctgtctccacacctgacccctacttacctgatcaactgtctcctccacgggtcccattgcggtcccaccacttccaaattcttcctagctacccaactgtttctcctgcccgccagccccatatactgcctatccatccatctgtaccctctactcttccaaagacctttgcaccagtcccattactgccttacccaattaaatatcatccttgtcctccaaccccggctacttccagcatttctagcagtttccctcgtctaccagcaccaattccttcttgcccacctggccatccaccccacgcaccccagagttctccaatcattcctgaccctgagtcacagcacaagttattttacaaaactttcagacccaaacatttccttccagcacagcattctactgcagccactctaatgcctacccttgttcgtcgttcccttccagctccactggttgtttccccaacccctttggaacctctccctgttttgaagccttcctgtttatccagtcaccccccttatccaccagtccccactctttcttatgtcactccgttgcctgcacatcctgctagcttggatccttttcagtcagtccagcaatctgttccacaagccacagcattgtcaaatcagcccgaggcctttgcagatcatccaccagcctcagttctctcccttgcatctccctgtcattctccatcttcttctttgccttcatctccttctacttccacatccttttcttcagcctgtatactgttttcttcctcctcatctattctttcctcttcttcgacttcctgttctacttctccatccttacctccttcatctatccctcttttttcctctcctttgcattcatcttcctctccaggtttgcctccaacttatttagcttttccctctccagtttctcctgtttcttcttcctttatgatttcctcttcctttccccctattcttcactctccttctgtttctacctccccatctccttttattcctatccaccccttcaatcctcctcattgggggaagaaagtagagaagagaagagaagaaagtggagtagagaagaaaggaatagagaagaaagttgagacacgacaactttaaagagctatagattctgccttgccttccgcattatcaaaaaatgatcacaagcatcagaaacaactcttatccaaaatcaattgtgagaaagaaatgaatgaaaacatgagggcaaccttggctactagcaaaaatgtgttccagcttaaactggaggaaactcagaaactcctcgaagatcaacatctaagcaatttgcaaaaattttgtgatgaagttaatcagataaccaattctgaaaccctctcaagtatagacagtcttgaggctacagagcatgaagaaatatatttaacacttaataaggagcattccacatccatccagcggaataccatttccctcaaaccagcaaatatgcaatcaactaatctcagctgctttgatgaagataaactggcattctctaaaactcaacatataaataattggcttacaaatttagatgcttcaaatactcagaatgtcacagctttctcagatattttaagtaaatctaatgttctgccttcatgggaatattttaatagtaaagaacaaaatccatctcctttgaatggaacagtggaaagagccacaaatactgctaataattcagtaccctttgtatctagcccacccatgtttgtactagataaaaaatgtgaaaagacctctgaaactagcactatgaggacaactgactccacttctggagcattcaaaagagagagaccattagttactgagagcccaacatttaaatttagcaaatcccaaagcacttcagattctctaacccaggaagtggctacatttccagaccaagagaaatattctgaattaaatcaagaaaatggaactacttcaattcctacttcatgtgtaccagtggcaacgcctttagttttgccatctaatatacagtcagctagaccttcagcaaagaacagtatacacataaaagaaattgatgcagtgcagtgttctgataagttagatgaattgaaagatggtaaagaagaagagataaaatattttaattgcaataaggaagagttgcctttattttcagacagttttcaagatgcctatatacctcacaatcctgattcaaaagatgaaaaacaaaaattagctgaaacatcatccttgtctaatgtaacttctaattatgactttgttggccagcataagaaaatgaaatacaacatccatgagagaaatggtgtgagatttcttaaaagtattttaaagaaagaatctaaatatgaacatggttatcttaaggcattaattataaatcagagctttaagtttggaaatcaaaaagcagcagctatcagagatagtattgaattaacaaaggaaaaaggtgcagaaattccaaagaccattaaaaaactgaggtggtttgatgaaactagcaatatagaaaacaatgctgaaaacagtcattcactgaagaataaaacaggaacaactcaacagcattctcaacaattccacattcaaagtggtgctggaagcaacataattagtgtttctacttgtgctgtaaattctgctgatacaaagaagtccagggaggattctatctctgaaaatgttacgactttaggaggatctggagcagaccatatgcctttgaactgttttataccttcaggttataactttgctaaacatgcctggccagcctcaaaaaaagaagaaagtaaaatccctgtacatgatgattctaaaactaagcaaggtaagccacaaagaggtagagcaaaaataattagaaaaccaggatctgcaaaagtccaatcaggctttatatgtacaaacagaaaaggcgctgtcattcaaccacagtctgcaagcaaagtcaacatatttacacaagctcagggaaaattaattataccttgtcctcctcctcaatctacatcaaatattagaagtggtaaaaatatacaagtgtctcagtgtcaaccagtaactcctgaaaatcctcaaaacattattacacataactcttttaattcaaaacatgtgcttccaacagaacacagtttgaatcagtggaatcaggaaagtagttctccactctcaaatgcttgttctgacctagtcactgtgataccatcactgccatcatattgttcttcagagtgccaaactttcgcaaaaataaatcattcaaatggcactcaagcagttgcccggcaagatgcgacattatattgcacccaaagaagtcctgtttgtgaagaaagttatccgtctgtgactctaagaactgctgaagaagaatcagttcccttatggaaaagaggtcctaatgtcctgcatcaaaataagagggctacagggtctactgttatgagaagaaaacgaattgctgaaactaagcggagaaatattttagagcagaaaagacaaaaccctggatctgtaggacagaagtacagtgagcaaattaataattttggacaaagtgtcctgctaagttcaagtgagccaaaacaaactacaaggggtacttcttatattgaagaagtttcagatagtacttctgagtttttgatggctgaaaacttagtgaaagcatcagtgccggaggatgagattctgactgtcttgaatagcaaacagatacagaaatcaaatctacctttaaataaaactcaacaattcaacatctgcacactgtcagctgaagaacagaagatcctagagtcccttaatgatctcagtgaaagactacattatatacaagaatccatttgcaaaaacccatccatcaaaaatactttacaaataataccacttctggagaagagagaagatagaaccagcagctgcagagacaagagataattccagcagaatccgtctaagaagacctttcatgtacttccctaggactagatgcataccgttttgtgaaaaccagccataggaaaacatgtgagcaacaacccccatgaacatttgtcctaactcagattttgtgagcagtgaagtttaacagagcagtgacatttaacaaagcagtgaagtttaacagagttctgagaataccatgaaagacattatgcctgcctaaacaaaaagcaggacataacctagctctgaatacatgccacaaggatgaagcttgtgagtagagcaaacaaacgtttttccaaagaattcacagtgctcctttgcaatttatagatttcatgttgaaatatatgttaaataaaatttctgtttattg

SEQ ID NO: 116440 - DNA, 631 bp, Homo sapiens
  Payload ID: 2720
  Gene Symbol: CEP126
  Gene Name: centrosomal protein 126kDa
  ENST ID: ENST00000532077
  CDS Start-End: 1-244
agagcagaaaagacaaaaccctggatctgtaggacagaagtacagtgagcaaattaataattttggacaaagtgtcctgctaagttcaagtgagccaaaacaaactacaaggggtacttcttatattgaagaagatatacaagaatccatttgcaaaaacccatccatcaaaaatactttacaaataataccacttctggagaagagagaagatagaaccagcagctgcagagacaagagataattccagcagaatccgtctaagaagacctttcatgtacttccctaggactagatgcataccgttttgtgaaaaccagccataggaaaacatgtgagcaacaacccccatgaacatttgtcctaactcagattttgtgagcagtgaagtttaacagagcagtgacatttaacaaagcagtgaagtttaacagagttctgagaataccatgaaagacattatgcctgcctaaacaaaaagcaggacataacctagctctgaatacatgccacaaggatgaagcttgtgagtagagcaaacaaacgtttttccaaagaattcacagtgctcctttgcaatttatagatttcatgttgaaatatatgttaaataaaatttctgtttattgaa

SEQ ID NO: 116441 - DNA, 1606 bp, Homo sapiens
  Payload ID: 2721
  Gene Symbol: CEP128
  Gene Name: centrosomal protein 128kDa
  Uniprot ID: Q6ZU80
  ENST ID: ENST00000216517
  CDS Start-End: 279-1586
gctgcgtttggtcagttgcaccttctgggtcactggtagccgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttggagatgatttcaacagggagctttccagaaggagccggtcagatgccgaaacaaaaagggctttggaagaattgactgaaaaacttaatgaagcccagaaacaagaagtggtttcagatcgggtggagcggcggcttcaggaactggagagagagatgcgcacagaaagggagctggtggaaagacgccaggatcaactgggactcatgtccctgcagctacaggaggcactaaagaaacaagaagctaaagcagatgagcatgagggggcaataaaaaataagctaagacaaactgaaactgagaagaatcaacttgaacaggaattggagctatctcgaaggttattgaatcaatcagaaggcagccgagaaacacttttgcatcaggtagaagaactgcgtacacaacttacgaaagcagaaggtgatcgaaagggtttacagcatcaagtatctcagatttccaagcaacagtcaaactatcaggatgaacaaggggaggactggagatttaggagaggggttgagcgggaaaaacaggacctggagaagcaaatgtcagatttgagagtgcagctgaacttcagcgcaatggcatctgagttagaggaagtgaaacggtgcatggagagaaaagacaaggagaaagcacatttggcatcacaagtagagcacatcaatagaaaatgtcttttaaatttggttcaagatttggattgtaaagataatgaaatattgacatactctttacaaagccctctacatgtttaataaagacttacttgaaattg

SEQ ID NO: 116442 - DNA, 4461 bp, Homo sapiens
  Payload ID: 2721
  Gene Symbol: CEP128
  Gene Name: centrosomal protein 128kDa
  Uniprot ID: Q6ZU80
  ENST ID: ENST00000281129
  CDS Start-End: 172-3456
gtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttggagatgatttcaacagggagctttccagaaggagccggtcagatgccgaaacaaaaagggctttggaagaattgactgaaaaacttaatgaagcccagaaacaagaagtggtttcagatcgggtggagcggcggcttcaggaactggagagagagatgcgcacagaaagggagctggtggaaagacgccaggatcaactgggactcatgtccctgcagctacaggaggcactaaagaaacaagaagctaaagcagatgagcatgagggggcaataaaaaataagctaagacaaactgaaactgagaagaatcaacttgaacaggaattggagctatctcgaaggttattgaatcaatcagaaggcagccgagaaacacttttgcatcaggtagaagaactgcgtacacaacttacgaaagcagaaggtgatcgaaagggtttacagcatcaagtatctcagatttccaagcaacagtcaaactatcaggatgaacaaggggaggactggagatttaggagaggggttgagcgggaaaaacaggacctggagaagcaaatgtcagatttgagagtgcagctgaacttcagcgcaatggcatctgagttagaggaagtgaaacggtgcatggagagaaaagacaaggagaaagcacatttggcatcacaagtagagaatttaacacgtgaactggagaatggggaaaaacagcaactgcagatgttggatcgacttaaggagatccagaatcactttgacacatgtgaggccgagcgtaagcatgctgaccttcagatctcagagctgactcgccatgcggaggatgcaaccaagcaggctgagcggtacctcagtgagctccagcagtcagaggctctgaaagaggaggcggagaagaggagggaagacctgaaactgaaagctcaagaatccattaggcagtggaagcttaagcataagaagttagaacgagcgttggagaaacaatctgaaactgttgatgaactgacaggcaagaataatcagattttaaaagaaaaggatgaattgaaaacccagctgtatgcagcattacaacaaatagagaatcttcgaaaggaattgaatgatgtcctaacaaagcgtgcccttcaggaggaggagcttcactccaaggaggagaaattacgtgatattaagtctcatcaagctgaccttgaattggaagttaagaattccctggataccatccatagactggagagcgaattgaaaaagcagagtaagatccaaagccagatgaaagttgagaaagctcacttggaggaagaaattgcagagctcaagaagagccaggcccaggacaaagctaaacttcttgagatgcaagagtccatcaaggacctgagtgccatccgagcagatcttgctaataaattggctgaggaagagagagccaagaaagcagtgcttaaggacctttctgacctcactgcacaggcaaaatccagggatgaagaaacagctacaatcatcacacagttaaagctggaacgagatgtgcaccagagggagctgaaagatctcacatcatcattgcagagtgtgaaaacaaaacacgaacagaatatccaggagcttatgaagcactttaagaaagaaaagagtgaggctgagaatcatatcaggactctgaaggctgaaagtttagaagagaagaatatggctaaaattcatcgtggtcagctggagaagttgaaatcacagtgtgacagactgacagaggaattaacccagaatgaaaatgagaacaaaaaactgaagctaaaatatcaatgtttgaaggatcaactagaagaaagggaaaaacatataagcattgaagaggagcacttaaggaggatggaagaggccagattgcagctcaaggatcaacttctttgcttggagactgaacaggaatccattcttggtgtgataggaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagagatctactggaagagacccaaagaaaagatgaagaaatgggatctctgcaggaccgtgtaattgcattagaaacgagtacccaagtggccttggaccatctggagtctgtgcctgagaaactgagcctactagaagatttcaaagacttcagagattcctgcagttcatctgagagaactgatggaagatattccaaatacagggttcgcagaaattctcttcagcatcaccaagatgacaccaagtacagaaccaaaagtttcaaaggtgacagaacctttctggaaggttcccacactcgtgggttagatcactcatcctcttggcaggatcacagtcgcttcctgtctagtccaagattttcatacgtgaactcatttaccaaaagaactgttgctccagattcagcttcaaacaaggaagatgccacaatgaatggaacaagttcacaacccaaaaaagaggaatatgggagctaaaaaagcaaatgtaatttgttattttacatgagtatgttacaaataataacatctctattcttacagcaatttggcccagattatctaacagacatacctgcagctttggctctttggtattgccaaacattgacaaaagtgacaatactgttggtccttgtgaatggtaaaccaatccaaataatatcagatcatgaatgatgtgcagctaatttatttgcaacttatactagcacagaaagaatgatattttttcactttgtattttcctttttcaagtgtggtcagtcacattttcccaaccaaaatttggatttctaattgaggccttttaaaaattactggctaaaaagaaggaaaatgagtttcccttgaggcaaaagttgccagcactttagattcagggagcatttatatacaactgattttttgaaaaattttctccctaataaattatcatgtgttataacatgtggagatgtgcatatataacattagacagtccactttataaatgctcaggacttttatatctatcatcttaacagtccacaactgcataccgtagctgaaaattatttccaatcatccatttttaatagcaataaagaattcataaatgatatctgaactgtagagcactgtaaagaattcatagcacaatttatttatttgtctttttgtggccaaatatcctactgtgatcacttcagtcatatcctggaccgtctttggtttactgtgactaaaatcatagcaccaaactcctttgtccatgagatttatatataatcttgtataatttggtcctatctgcttctaccatcccaacttttttcatcaaagtgtctaagaacgtattccctttacacgctgatctcctagtggagaaggatttatattaaatgctaagtaatagtaaactttcaggaactgaatcctattgggtcatggattctgcatagacaagggcaataaagcaatacctttgtaatatgcattaca

SEQ ID NO: 116443 - DNA, 1823 bp, Homo sapiens
  Payload ID: 2721
  Gene Symbol: CEP128
  Gene Name: centrosomal protein 128kDa
  ENST ID: ENST00000554827
  CDS Start-End: 1-908
tccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttggagatgatttcaacagggagctttccagaaggagccggtcagatgccgaaacaaaaagggctttggaagaattgactgaaaaacttaatgaagcccagaaacaagaagtggtttcagatcgggtggagcggcggcttcaggaactggagagagagatgcgcacagaaagggagctggtggaaagacgccaggatcaactgggactcatgtccctgcagctacaggaggcactaaagaaacaagaagctaaagcagatgagcatgagggggcaataaaaaataagctaagacaaactgaaactgagaagaatcaacttgaacaggaattggagctatctcgaaggttattgaatcaatcagaaggcagccgagaaacacttttgcatcaggtagaagaactgcgtacacaacttacgaaagcagaaggtgatcgaaagggtttacagcatcaagtatctcagatttccaagcaacagtcaaactatcaggatgaacaaggggaggactggagatttaggagaggggttgagcgggaaaaacaggacctggagaagcaaatgtcagatttgagagtgcagctgaacttcagcgcaatggcatctgagttagaggaagtgaaacggtgcatggagagaaaagacaaggagaaagcacatttggcatcacaagtagaggtgactttgctctttttaagtcatattcgaaatattttaattttatctcatggaattgcttaatgaaattttaatataaagatgtgttattttatgaactccagtgtgagcattgataatataaagttatattaatgactgatttacttatatgtagaaattcctatgggttcatttctctttcattcaggaccccaaagccaggaacctggatgattttcctttattattttacagagaaatcctttactatttttaaatttgaaaatatttttgttctaatagcaattgaaccctttctacagacagaagggaccttttttgtttgagagaacagtgaattattatttattttgcgggtgaaactggcagaatgcatagtgaaaaggtgttaccaataattcttctttggaaccataaaggttttcagacctctagttgttctgcatgaggtggaattgcaatgcctccattaatttagagttgtgtagcaatcatggatgatatggtaaccgtgaatggagtataactaggcagctaccatttcctgcttttatctagcatagatgaggtaattatcagtatatattaaaaatcaaaggaaaagacctcataaaaggaaatggtttaattgaaattacaattatgcaaattagattaaacatggatgacacatttggaaatagatatgtatcaatcctccctgtatctgtttttgtaagtgaagttgtgttctaatttcaagtatttccaaaattaaaatgaaaggtagaaaattagtgttaaaagcacctaattttatataacccaaaggaaatatttaatgttactcatctgtgtttctctttcatcttgtcagcacatcaatagaaaatgtcttttaaatttggttcaagatttggattgtaaagataatgaaatattgacatactctttacaaagccctctacatgtttaataaagacttacttgaaattg

SEQ ID NO: 116444 - DNA, 869 bp, Homo sapiens
  Payload ID: 2721
  Gene Symbol: CEP128
  Gene Name: centrosomal protein 128kDa
  ENST ID: ENST00000555529
  CDS Start-End: 333-869
cagagaaggaaggatcttctcatgcacagaggcaacaaatggcaactttctgagtcctcatctataaaatgagcataataacatcacctacttaattggatttggtgaggattcactgggtgagttcatgcaaagcgctgagaacaggaccccccgcccccgtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttgga

SEQ ID NO: 116445 - DNA, 4662 bp, Homo sapiens
  Payload ID: 2721
  Gene Symbol: CEP128
  Gene Name: centrosomal protein 128kDa
  Uniprot ID: Q6ZU80
  ENST ID: ENST00000555265
  CDS Start-End: 377-3661
caagcggcggcagcggggtcctgtactcttgctgtggctgggcggctagttcaagttgccatagctgcgagtctggggagagcacagtcggttgagtcgctgcgtttggtcagttgcaccttctgggtcactggtagccgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttggagatgatttcaacagggagctttccagaaggagccggtcagatgccgaaacaaaaagggctttggaagaattgactgaaaaacttaatgaagcccagaaacaagaagtggtttcagatcgggtggagcggcggcttcaggaactggagagagagatgcgcacagaaagggagctggtggaaagacgccaggatcaactgggactcatgtccctgcagctacaggaggcactaaagaaacaagaagctaaagcagatgagcatgagggggcaataaaaaataagctaagacaaactgaaactgagaagaatcaacttgaacaggaattggagctatctcgaaggttattgaatcaatcagaaggcagccgagaaacacttttgcatcaggtagaagaactgcgtacacaacttacgaaagcagaaggtgatcgaaagggtttacagcatcaagtatctcagatttccaagcaacagtcaaactatcaggatgaacaaggggaggactggagatttaggagaggggttgagcgggaaaaacaggacctggagaagcaaatgtcagatttgagagtgcagctgaacttcagcgcaatggcatctgagttagaggaagtgaaacggtgcatggagagaaaagacaaggagaaagcacatttggcatcacaagtagagaatttaacacgtgaactggagaatggggaaaaacagcaactgcagatgttggatcgacttaaggagatccagaatcactttgacacatgtgaggccgagcgtaagcatgctgaccttcagatctcagagctgactcgccatgcggaggatgcaaccaagcaggctgagcggtacctcagtgagctccagcagtcagaggctctgaaagaggaggcggagaagaggagggaagacctgaaactgaaagctcaagaatccattaggcagtggaagcttaagcataagaagttagaacgagcgttggagaaacaatctgaaactgttgatgaactgacaggcaagaataatcagattttaaaagaaaaggatgaattgaaaacccagctgtatgcagcattacaacaaatagagaatcttcgaaaggaattgaatgatgtcctaacaaagcgtgcccttcaggaggaggagcttcactccaaggaggagaaattacgtgatattaagtctcatcaagctgaccttgaattggaagttaagaattccctggataccatccatagactggagagcgaattgaaaaagcagagtaagatccaaagccagatgaaagttgagaaagctcacttggaggaagaaattgcagagctcaagaagagccaggcccaggacaaagctaaacttcttgagatgcaagagtccatcaaggacctgagtgccatccgagcagatcttgctaataaattggctgaggaagagagagccaagaaagcagtgcttaaggacctttctgacctcactgcacaggcaaaatccagggatgaagaaacagctacaatcatcacacagttaaagctggaacgagatgtgcaccagagggagctgaaagatctcacatcatcattgcagagtgtgaaaacaaaacacgaacagaatatccaggagcttatgaagcactttaagaaagaaaagagtgaggctgagaatcatatcaggactctgaaggctgaaagtttagaagagaagaatatggctaaaattcatcgtggtcagctggagaagttgaaatcacagtgtgacagactgacagaggaattaacccagaatgaaaatgagaacaaaaaactgaagctaaaatatcaatgtttgaaggatcaactagaagaaagggaaaaacatataagcattgaagaggagcacttaaggaggatggaagaggccagattgcagctcaaggatcaacttctttgcttggagactgaacaggaatccattcttggtgtgataggaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagagatctactggaagagacccaaagaaaagatgaagaaatgggatctctgcaggaccgtgtaattgcattagaaacgagtacccaagtggccttggaccatctggagtctgtgcctgagaaactgagcctactagaagatttcaaagacttcagagattcctgcagttcatctgagagaactgatggaagatattccaaatacagggttcgcagaaattctcttcagcatcaccaagatgacaccaagtacagaaccaaaagtttcaaaggtgacagaacctttctggaaggttcccacactcgtgggttagatcactcatcctcttggcaggatcacagtcgcttcctgtctagtccaagattttcatacgtgaactcatttaccaaaagaactgttgctccagattcagcttcaaacaaggaagatgccacaatgaatggaacaagttcacaacccaaaaaagaggaatatgggagctaaaaaagcaaatgtaatttgttattttacatgagtatgttacaaataataacatctctattcttacagcaatttggcccagattatctaacagacatacctgcagctttggctctttggtattgccaaacattgacaaaagtgacaatactgttggtccttgtgaatggtaaaccaatccaaataatatcagatcatgaatgatgtgcagctaatttatttgcaacttatactagcacagaaagaatgatattttttcactttgtattttcctttttcaagtgtggtcagtcacattttcccaaccaaaatttggatttctaattgaggccttttaaaaattactggctaaaaagaaggaaaatgagtttcccttgaggcaaaagttgccagcactttagattcagggagcatttatatacaactgattttttgaaaaattttctccctaataaattatcatgtgttataacatgtggagatgtgcatatataacattagacagtccactttataaatgctcaggacttttatatctatcatcttaacagtccacaactgcataccgtagctgaaaattatttccaatcatccatttttaatagcaataaagaattcataaatgatatctgaactgtagagcactgtaaagaattcatagcacaatttatttatttgtctttttgtggccaaatatcctactgtgatcacttcagtcatatcctggaccgtctttggtttactgtgactaaaatcatagcaccaaactcctttgtccatgagatttatatataatcttgtataatttggtcctatctgcttctaccatcccaacttttttcatcaaagtgtctaagaacgtattccctttacacgctgatctcctagtggagaaggatttatattaaatgctaagtaatagtaaactttcaggaactgaatcctattgggtcatggattctgcatagacaagggcaataaagcaatacctttgtaatatgcat

SEQ ID NO: 116446 - DNA, 576 bp, Homo sapiens
  Payload ID: 2721
  Gene Symbol: CEP128
  Gene Name: centrosomal protein 128kDa
  ENST ID: ENST00000556042
  CDS Start-End: 194-576
ctttctacctccttattcagagaaggaaggatcttctcatgcacagaggcaacaaatggcaactttctgagtcctcatctataaaatgagcataataacatcacctacttaattggatttggtgaggattcactgggtgagttcatgcaaagcgctgagaacaggaccccccgcccccgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctac

SEQ ID NO: 116447 - DNA, 729 bp, Homo sapiens
  Payload ID: 2721
  Gene Symbol: CEP128
  Gene Name: centrosomal protein 128kDa
  ENST ID: ENST00000554728
  CDS Start-End: 1-420
gaggagcacttaaggaggatggaagaggccagattgcagctcaaggatcaacttctttgcttggagactgaacaggaatccattcttggtgtgataggaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagaggtgtgtgttagttgttctttcatttttctttgtttatatttatggaatcctaatcctaggattggaaaaaaacctacttctgttgcatcccctttggactatttccaagcccatctccttttcttgtctttgtcttcttatctttcttcatttctgggacgagaagagaaaattcttcagccacagcattcctcctgtgtatatgataactgcatttactggctgtgtgcaggaattaattgataagacatactgcttctgtcttagtaaaatgctgatgtttacatttacttcagtaaaatacgtcttagttcattcaa

SEQ ID NO: 116448 - DNA, 3774 bp, Homo sapiens
  Payload ID: 2721
  Gene Symbol: CEP128
  Gene Name: centrosomal protein 128kDa
  ENST ID: ENST00000554502
  CDS Start-End: 1-2039
tagaagaactgcgtacacaacttacgaaagcagaaggtgatcgaaagggtttacagcatcaagtatctcagatttccaagcaacagtcaaactatcaggatgaacaaggggaggactggagatttaggagaggggttgagcgggaaaaacaggacctggagaagcaaatgtcagatttgagagtgcagctgaacttcagcgcaatggcatctgagttagaggaagtgaaacggtgcatggagagaaaagacaaggagaaagcacatttggcatcacaagtagagaatttaacacgtgaactggagaatggggaaaaacagcaactgcagatgttggatcgacttaaggagatccagaatcactttgacacatgtgaggccgagcgtaagcatgctgaccttcagatctcagagctgactcgccatgcggaggatgcaaccaagcaggctgagcggtacctcagtgagctccagcagtcagaggctctgaaagaggaggcggagaagaggagggaagacctgaaactgaaagctcaagaatccattaggcagtggaagcttaagcataagaagttagaacgagcgttggagaaacaatctgaaactgttgatgaactgacaggcaagaataatcagattttaaaagaaaaggatgaattgaaaacccagctgtatgcagcattacaacaaatagagaatcttcgaaaggaattgaatgatgtcctaacaaagcgtgcccttcaggaggaggagcttcactccaaggaggagaaattacgtgatattaagtctcatcaagctgaccttgaattggaagttaagaattccctggataccatccatagactggagagcgaattgaaaaagcagagtaagatccaaagccagatgaaagttgagaaagctcacttggaggaagaaattgcagagctcaagaagagccaggcccaggacaaagctaaacttcttgagatgcaagagtccatcaaggacctgagtgccatccgagcagatcttgctaataaattggctgaggaagagagagccaagaaagcagtgcttaaggacctttctgacctcactgcacaggcaaaatccagggatgaagaaacagctacaatcatcacacagttaaagctggaacgagatgtgcaccagagggagctgaaagatctcacatcatcattgcagagtgtgaaaacaaaacacgaacagaatatccaggagcttatgaagcactttaagaaagaaaagagtgaggctgagaatcatatcaggactctgaaggctgaaagtttagaagagaagaatatggctaaaattcatcgtggtcagctggagaagttgaaatcacagtgtgacagactgacagaggaattaacccagaatgaaaatgagaacaaaaaactgaagctaaaatatcaatgtttgaaggatcaactagaagaaagggaaaaacatataagcattgaagaggagcacttaaggaggatggaagaggccagattgcagctcaaggatcaacttctttgcttggagactgaacaggaatccattcttggtgtgataggaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagagatctactggaagagacccaaagaaaagatgaagaaatgggatctctgcaggaccgtgtaattgcattagaaacgagtacccaagtggccttggaccatctggagtctgtgcctgagaaactgagcctactagaagatttcaaagacttcagaaggtgaggtttcaccatgttgcccaggctggtctcgaactcctggactagagctatcctcccaccttggcctcctaaagtgctgggattacaggattcctgcagttcatctgagagaactgatggaagatattccaaatacagggttcgcagaaattctcttcagcatcaccaagatgacaccaagtacagaaccaaaagtttcaaaggtgacagaacctttctggaaggttcccacactcgtgggttagatcactcatcctcttggcaggatcacagtcgcttcctgtctagtccaagattttcatacgtgaactagggtgttttaaatagcatttccaggaaaggaaggctggaaggctgctgtcaaccacactacactgcttaaatctcgtggagccatgatggtgcatcaggttttgctatgcctatcttctctgcaacccaagagagggaacaaagagcagccaggtgggattagatgctgggggcttaagcaataactgactccattttctgtttctacactccagccagtgccaagtgattttttaaaaatttaaatacttttctgccctatcaaatacagggtatacactactgaaagaacgctctgctagtaaaaagtgtttattgattcaagcagaaaaaaggggggaaaaaactgtgggtgtcagatgaagctgaagggaagtatccaggaagagagggaggaatggggagcttttcttttgagtgtcctattaaaatgtgtgagtggaagttgggggtggatttcatgagtaaatatggaattttgccaccaaattctttcctccagagctaatattctcatgggatgttaatattaatacaaggaaaaaggccctgggtgaagaaaaattattttccccttcaggggcagagttctctcaggacgacagtgaggttaaagagttccagaaaatgctagtagaactttaagcacgctatcattaacagacagaaaaacagactacaacctactggattcattttggaaagtagaaaaaaggaatctggtaaaatcagccaaagcaaggacctttccccctccttagaactcgctaagctttccatggtgtgtgggccttttagttccactcattattcaggcctaattcaggtcatcaaaatagaaatgcatgggacaggtgactgacatgactgcatcgtggtttagatgtatagataacacggggaggtgctttacattttaagactttgttcataattcttttatttatggtttctctgaatcattcttttggaacattctaaaagagccagaggaaaaaaatggaactttttctcaagggacttgacttagtggatagctaaatgtccagtttcaaaagcttatccttttgaaatgcttttatacttataaaagcccaaagaaaccttaatatgggccacataactataatgtaatttttccaaggtaggaaaggcagtaatactgtactattagaatatatggattttcataagagcagctgttgtttcactaaggtttacattattttaggtcctagttttctgtttggaggtgtattaatgagttccttggttaatttattcccattctctatatttctgattcttaattgtatgatgtggtttatattcattgttttgacgtgataggaatgccaacaatgtgcctttggttttcttatgcttaaaaaataaaaaaataaataaacattaaatgtaaaatc

SEQ ID NO: 116449 - DNA, 545 bp, Homo sapiens
  Payload ID: 2721
  Gene Symbol: CEP128
  Gene Name: centrosomal protein 128kDa
  ENST ID: ENST00000556981
  CDS Start-End: 450-545
atcctttctacctccttattcagagaaggaaggatcttctcatgcacagaggcaacaaatggcaactttctgagtcctcatctataaaatgagcataataacatcacctacttaattggatttggtgaggattcactgggtgagttcatgcaaagcgctgagaacaggaccccccgcccccagtgaggagatgacacctagactgaagtagcagcagtaatgagctgacagcctcacatctacttttggtgtgccgtgaataagccatatgatcttaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtctt

SEQ ID NO: 116450 - DNA, 735 bp, Homo sapiens
  Payload ID: 2721
  Gene Symbol: CEP128
  Gene Name: centrosomal protein 128kDa
  ENST ID: ENST00000556061
  CDS Start-End: 1-481
agatctactggaagagacccaaagaaaagatgaagaaatgggatctctgcaggaccgtgtaattgcattagaaacgagtacccaagtggccttggaccatctggagtctgtgcctgagaaactgagcctactagaagatttcaaagacttcagagattcctgcagttcatctgagagaactgatggaagatattccaaatacagggttcgcagaaattctcttcagcatcaccaagatgacaccaagtacagaaccaaaagtttcaaaggtgacagaacctttctggaaggttcccacactcgtgggttagatcactcatcctcttggcaggatcacagtcgcttcctgtctagtccaagattttcatacgtgaactcatttaccaaaagaactgttgctccagattcagcttcaaacaaggaagatgccacaatgaatggaacaagttcacaacccaaaaaagaggaatatgggagctaaaaaagcaaatgtatccgagctgtgattcagtcctgaggctcacccaagtggaggtcttaaagccatttccaaagatgcttgattaactactaaaggttacttcccacctcctccttctaacagactatgccaggactctgcccattcatcaggatcatcatcaagacatccaattaaatcagggcctatagtatagttcttctgtttggcttgaaggacagaagtagtatttgattataaaagttgcaaatgtc

SEQ ID NO: 116451 - DNA, 528 bp, Homo sapiens
  Payload ID: 2721
  Gene Symbol: CEP128
  Gene Name: centrosomal protein 128kDa
  ENST ID: ENST00000557411
  CDS Start-End: 469-528
gcgagtctggggagagcacagtcggttgagtcgctgcgtttggtcagttgcaccttctgggtcactggtagccgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatgtgaga

SEQ ID NO: 116452 - DNA, 3673 bp, Homo sapiens
  Payload ID: 2722
  Gene Symbol: CEP131
  Gene Name: centrosomal protein 131kDa
  Uniprot ID: Q9UPN4
  ENST ID: ENST00000269392
  CDS Start-End: 249-3500
gacgggctggggaggtggtgccaggctggttgctagctgccgccgctgctcaccccggccgtccggccgcttcattgtcaccgggcctcggggcagtgttgggggtggcggggcgccaggtcgccgacccgaggtttgggcgcgactggttccgcatcccctccccgccggccgaatctgcaggccccgcgcgccaggcaggcttcgcggctgcgcccccggcccgcgcaggacctgccttgtccaccatgaaaggcacccgggccatcggcagcgtcccggagcgcagcccagcaggtgtggacctgagtctgacaggtctccctccgcctgtgtcccggcgtcctggcagtgccgccaccaccaagcccatcgtccgctctgtctccgtggtcacaggcagcgagcagaagaggaaggtgctggaggccacagggcctgggggctcccaggccatcaacaaccttagaagatccaacagcaccacgcaggtcagccagcctcggagcggctcccccaggccaacggagcccacagacttcctgatgctcttcgagggcagccccagtgggaaaaagaggcctgccagcctgagcacagcccccagcgagaagggagccacctggaacgtcctggatgaccagccccggggcttcaccttgccatccaatgcccggagttccagtgcccttgactcaccagcgggcccgcggaggaaagaatgcaccgtggccctggcccccaacttcactgctaacaacaggagcaacaagggagcagtgggcaactgcgtcaccaccatggtgcacaaccgctacaccccctcggagagggcgcctccgctcaagagctccaaccagactgccccctccctcaacaacatcatcaaggcagccacctgtgagggcagtgagagcagcggctttgggaagctgccgaagaatgtctccagtgccacccactcagcccggaacaatactgggggcagcacgggcttgcccaggcggaaggaggtgacggaggaggaggctgagaggtttatccaccaggtgaaccaggccactgtcaccatccagcgctggtaccggcaccaggtgcagcggcgcggagcaggagctgcccgcctggagcacttgcttcaggccaagcgggaggagcagcggcagcggtcaggcgaggggaccctcttggacctgcaccagcagaaagaggcagccaggaggaaggcccgggaggagaaggcacgccaagccaggcgagcagccattcaggagctgcaacagaaacgagccctgagagcccagaaggcgagcactgccgagcgtgggccacctgagaatcccagggagaccagagtgccaggaatgcggcagcctgctcaggagctgtcccccacaccaggcggcactgcccaccaggccctcaaggccaacaatactggtggtggcctccctgctgcaggccccggagaccgctgcctgcccacctccgactcatccccagaaccacagcagcctccagaggacaggacgcaggacgttcttgcccaggatgcagctggggacaacctggagatgatggccccgagcagggggagcgccaagtccagggggccactggaggagctgctgcacacactgcagctgctggagaaggagccggacgtgctgccccgccccaggacccatcacaggggcagatacgcctgggccagcgaggtgaccacggaggatgacgccagctctctgacagctgacaacttggagaaatttggaaaactcagtgcgttccccgaacctcctgaggatgggacgctgctatcggaggccaagctacaaagcatcatgagcttcttggacgagatggagaagtctgggcaggaccagctggactcccagcaggaggggtgggtgccggaggcggggccggggcccctggagctggggtccgaggtgagcacgtctgtgatgcggctgaagctggaggtggaggagaagaagcaggccatgctgctgctgcagagagcgctggcgcagcagcgagacctcacggcccggcgggtcaaggagacagagaaggcgctgagccggcagctgcagcggcagagggagcactacgaggccaccatccagcggcacttggccttcattgaccagctgattgaggacaagaaggtcctgagtgaaaagtgcgaggctgtggtggccgagctgaagcaggaggaccagagatgcaccgagcgtgtggcccaggcacaggcgcagcacgagctggagattaaaaaactcaaagaattaatgagcgccaccgagaaagcccgccgggagaagtggatcagtgagaaaaccaagaagatcaaggaggtcactgtccgaggtctggagcccgagatccagaagctgattgcaaggcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggttccagcagcacctggagcaggagcagtgggcgctgcagcagcaacggcagcggctgtacagtgaggtggctgaggagagggagcggctgggccagcaggcagccaggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttcag

SEQ ID NO: 116453 - DNA, 3505 bp, Homo sapiens
  Payload ID: 2722
  Gene Symbol: CEP131
  Gene Name: centrosomal protein 131kDa
  Uniprot ID: Q9UPN4
  ENST ID: ENST00000374782
  CDS Start-End: 195-3329
ccggccgtccggccgcttcattgtcaccgggcctcggggcagtgttgggggtggcggggcgccaggtcgccgacccgaggtttgggcgcgactggttccgcatcccctccccgccggccgaatctgcaggccccgcgcgccaggcaggcttcgcggctgcgcccccggcccgcgcaggacctgccttgtccaccatgaaaggcacccgggccatcggcagcgtcccggagcgcagcccagcaggtgtggacctgagtctgacaggtctccctccgcctgtgtcccggcgtcctggcagtgccgccaccaccaagcccatcgtccgctctgtctccgtggtcacaggcagcgagcagaagaggaaggtgctggaggccacagggcctgggggctcccaggccatcaacaaccttagaagatccaacagcaccacgcaggtcagccagcctcggagcggctcccccaggccaacggagcccacagacttcctgatgctcttcgagggcagccccagtgggaaaaagaggcctgccagcctgagcacagcccccagcgagaagggagccacctggaacgtcctggatgaccagccccggggcttcaccttgccatccaatgcccggagttccagtgcccttgactcaccagcgggcccgcggaggaaagaatgcaccgtggccctggcccccaacttcactgctaacaacaggagcaacaagggagcagtgggcaactgcgtcaccaccatggtgcacaaccgctacaccccctcggagagggcgcctccgctcaagagctccaaccagactgccccctccctcaacaacatcatcaaggcagccacctgtgagggcagtgagagcagcggctttgggaagctgccgaagaatgtctccagtgccacccactcagcccggaacaatactgggggcagcacgggcttgcccaggcggaaggaggtgacggaggaggaggctgagaggtttatccaccaggtgaaccaggccactgtcaccatccagcgctggtaccggcaccaggtgcagcggcgcggagcaggagctgcccgcctggagcacttgcttcaggccaagcgggaggagcagcggcagcggtcaggcgaggggaccctcttggacctgcaccagcagaaagaggcagccaggaggaaggcccgggaggagaaggcacgccaagccaggcgagcagccattcaggagctgcaacagaaacgagccctgagagcccagaaggcgagcactgccgagcgtgggccacctgagaatcccagggagaccagagtgccaggaatgcggcagcctgctcaggagctgtcccccacaccaggcggcactgcccaccaggccctcaaggccaacaatactggtggtggcctccctgctgcaggccccggagaccgctgcctgcccacctccgactcatccccagaaccacagcagcctccagaggacaggacgcaggacgttcttgcccaggatgcagctggggacaacctggagatgatggccccgagcagggggagcgccaagtccagggggccactggaggagctgctgcacacactgcagctgctggagaaggagccggacgtgctgccccgccccaggacccatcacaggggcagatacgcctgggccagcgaggaggatgacgccagctctctgacagctgacaacttggagaaatttggaaaactcagtgcgttccccgaacctcctgaggatgggacgctgctatcggaggccaagctacaaagcatcatgagcttcttggacgagatggagaagtctgggcaggaccagctggactcccagcaggaggggtgggtgccggaggcggggccggggcccctggagctggggtccgaggtgagcacgtctgtgatgcggctgaagctggaggtggaggagaagaagcaggccatgctgctgctgcagagagcgctggcgcagcagcgagacctcacggcccggcgggtcaaggagacagagaaggcgctgagccggcagctgcagcggcagagggagcactacgaggccaccatccagcggcacttggccttcattgaccagctgattgaggacaagaaggtcctgagtgaaaagtgcgaggctgtggtggccgagctgaagcaggaggaccagagatgcaccgagcgtgtggcccaggcacaggcgcagcacgagctggagattaaaaaactcaaagaattaatgagcgccaccgagaaagcccgccgggagaagtggatcagtgagaaaaccaagaagatcaaggaggtcactgtccgaggtctggagcccgagatccagaagctgattgcaaggcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttcagcgc

SEQ ID NO: 116454 - DNA, 3543 bp, Homo sapiens
  Payload ID: 2722
  Gene Symbol: CEP131
  Gene Name: centrosomal protein 131kDa
  Uniprot ID: Q9UPN4
  ENST ID: ENST00000450824
  CDS Start-End: 180-3422
cttcattgtcaccgggcctcggggcagtgttgggggtggcggggcgccaggtcgccgacccgaggtttgggcgcgactggttccgcatcccctccccgccggccgaatctgcaggccccgcgcgccaggcaggcttcgcggctgcgcccccggcccgcgcaggacctgccttgtccaccatgaaaggcacccgggccatcggcagcgtcccggagcgcagcccagcaggtgtggacctgagtctgacaggtctccctccgcctgtgtcccggcgtcctggcagtgccgccaccaccaagcccatcgtccgctctgtctccgtggtcacaggcagcgagcagaagaggaaggtgctggaggccacagggcctgggggctcccaggccatcaacaaccttagaagatccaacagcaccacgcaggtcagccagcctcggagcggctcccccaggccaacggagcccacagacttcctgatgctcttcgagggcagccccagtgggaaaaagaggcctgccagcctgagcacagcccccagcgagaagggagccacctggaacgtcctggatgaccagccccggggcttcaccttgccatccaatgcccggagttccagtgcccttgactcaccagcgggcccgcggaggaaagaatgcaccgtggccctggcccccaacttcactgctaacaacaggagcaacaagggagcagtgggcaactgcgtcaccaccatggtgcacaaccgctacaccccctcggagagggcgcctccgctcaagagctccaaccagactgccccctccctcaacaacatcatcaaggcagccacctgtgagggcagtgagagcagcggctttgggaagctgccgaagaatgtctccagtgccacccactcagcccggaacaatactgggggcagcacgggcttgcccaggcggaaggaggtgacggaggaggaggctgagaggtttatccaccaggtgaaccaggccactgtcaccatccagcgctggtaccggcaccaggtgcagcggcgcggagcaggagctgcccgcctggagcacttgcttcaggccaagcgggaggagcagcggcagcggtcaggcgaggggaccctcttggacctgcaccagcagaaagaggcagccaggaggaaggcccgggaggagaaggcacgccaagccaggcgagcagccattcaggagctgcaacagaaacgagccctgagagcccagaaggcgagcactgccgagcgtgggccacctgagaatcccagggagaccagagtgccaggaatgcggcagcctgctcaggagctgtcccccacaccaggcggcactgcccaccaggccctcaaggccaacaatactggtggtggcctccctgctgcaggccccggagaccgctgcctgcccacctccgactcatccccagaaccacagcagcctccagaggacaggacgcaggacgttcttgcccaggatgcagctggggacaacctggagatgatggccccgagcagggggagcgccaagtccagggggccactggaggagctgctgcacacactgcagctgctggagaaggagccggacgtgctgccccgccccaggacccatcacaggggcagatacgcctgggccagcgaggaggatgacgccagctctctgacagctgacaacttggagaaatttggaaaactcagtgcgttccccgaacctcctgaggatgggacgctgctatcggaggccaagctacaaagcatcatgagcttcttggacgagatggagaagtctgggcaggaccagctggactcccagcaggaggggtgggtgccggaggcggggccggggcccctggagctggggtccgaggtgagcacgtctgtgatgcggctgaagctggaggtggaggagaagaagcaggccatgctgctgctgcagagagcgctggcgcagcagcgagacctcacggcccggcgggtcaaggagacagagaaggcgctgagccggcagctgcagcggcagagggagcactacgaggccaccatccagcggcacttggccttcattgaccagctgattgaggacaagaaggtcctgagtgaaaagtgcgaggctgtggtggccgagctgaagcaggaggaccagagatgcaccgagcgtgtggcccaggcacaggcgcagcacgagctggagattaaaaaactcaaagaattaatgagcgccaccgagaaagcccgccgggagaagtggatcagtgagaaaaccaagaagatcaaggaggtcactgtccgaggtctggagcccgagatccagaagctgattgcaaggcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggttccagcagcacctggagcaggagcagtgggcgctgcagcagcaacggcagcggctgtacagtgaggtggctgaggagagggagcggctgggccagcaggcagccaggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccac

SEQ ID NO: 116455 - DNA, 3444 bp, Homo sapiens
  Payload ID: 2722
  Gene Symbol: CEP131
  Gene Name: centrosomal protein 131kDa
  ENST ID: ENST00000575907
  CDS Start-End: 180-3323
cttcattgtcaccgggcctcggggcagtgttgggggtggcggggcgccaggtcgccgacccgaggtttgggcgcgactggttccgcatcccctccccgccggccgaatctgcaggccccgcgcgccaggcaggcttcgcggctgcgcccccggcccgcgcaggacctgccttgtccaccatgaaaggcacccgggccatcggcagcgtcccggagcgcagcccagcaggtgtggacctgagtctgacaggtctccctccgcctgtgtcccggcgtcctggcagtgccgccaccaccaagcccatcgtccgctctgtctccgtggtcacaggcagcgagcagaagaggaaggtgctggaggccacagggcctgggggctcccaggccatcaacaaccttagaagatccaacagcaccacgcaggtcagccagcctcggagcggctcccccaggccaacggagcccacagacttcctgatgctcttcgagggcagccccagtgggaaaaagaggcctgccagcctgagcacagcccccagcgagaagggagccacctggaacgtcctggatgaccagccccggggcttcaccttgccatccaatgcccggagttccagtgcccttgactcaccagcgggcccgcggaggaaagaatgcaccgtggccctggcccccaacttcactgctaacaacaggagcaacaagggagcagtgggcaactgcgtcaccaccatggtgcacaaccgctacaccccctcggagagggcgcctccgctcaagagctccaaccagactgccccctccctcaacaacatcatcaaggcagccacctgtgagggcagtgagagcagcggctttgggaagctgccgaagaatgtctccagtgccacccactcagcccggaacaatactgggggcagcacgggcttgcccaggcggaaggaggtgacggaggaggaggctgagaggtttatccaccaggtgaaccaggccactgtcaccatccagcgctggtaccggcaccaggtgcagcggcgcggagcaggagctgcccgcctggagcacttgcttcaggccaagcgggaggagcagcggcagcggtcaggcgaggggaccctcttggacctgcaccagcagaaagaggcagccaggaggaaggcccgggaggagaaggcacgccaagccaggcgagcagccattcaggagctgcaacagaaacgagccctgagagcccagaaggcgagcactgccgagcgtgggccacctgagaatcccagggagaccagagtgccaggaatgcggcagcctgctcaggagctgtcccccacaccaggcggcactgcccaccaggccctcaaggccaacaatactggtggtggcctccctgctgcaggccccggagaccgctgcctgcccacctccgactcatccccagaaccacagcagcctccagaggacaggacgcaggacgttcttgcccaggatgcagctggggacaacctggagatgatggccccgagcagggggagcgccaagtccagggggccactggaggagctgctgcacacactgcagctgctggagaaggagccggacgtgctgccccgccccaggacccatcacaggggcagatacgcctgggccagcgaggtgaccacggaggatgacgccagctctctgacagctgacaacttggagaaatttggaaaactcagtgcgttccccgaacctcctgaggatgggacgctgctatcggaggccaagctacaaagcatcatgagcttcttggacgagatggagaagtctgggcaggaccagctggactcccagcaggaggggtgggtgccggaggcggggccggggcccctggagctggggtccgaggtgagcacgtctgtgatgcggctgaagctggaggtggaggagaagaagcaggccatgctgctgctgcagagagcgctggcgcagcagcgagacctcacggcccggcgggtcaaggagacagagaaggcgctgagccggcagctgcagcggcagagggagcactacgaggccaccatccagcggcacttggccttcattgaccagctgattgaggacaagaaggtcctgagtgaaaagtgcgaggctgtggtggccgagctgaagcaggaggaccagagatgcaccgagcgtgtggcccaggcacaggcgcagcacgagctggagattaaaaaactcaaagaattaatgagcgccaccgagaaagcccgccgggagaagtggatcagtgagaaaaccaagaagatcaaggaggtcactgtccgaggtctggagcccgagatccagaagctgattgcaaggcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccac

SEQ ID NO: 116456 - DNA, 1747 bp, Homo sapiens
  Payload ID: 2722
  Gene Symbol: CEP131
  Gene Name: centrosomal protein 131kDa
  ENST ID: ENST00000573053
  CDS Start-End: 1-1575
ctggggtccgaggtgagcacgtctgtgatgcggctgaagctggaggtggaggagaagaagcaggccatgctgctgctgcagagagcgctggcgcagcagcgagacctcacggcccggcgggtcaaggagacagagaaggcgctgagccggcagctgcagcggcagagggagcactacgaggccaccatccagcggcacttggccttcattgaccagctgattgaggacaagaaggtcctgagtgaaaagtgcgaggctgtggtggccgagctgaagcaggaggaccagagatgcaccgagcgtgtggcccaggcacaggcgcagcacgagctggagattaaaaaactcaaagaattaatgagcgccaccgagaaagcccgccgggagaagtggatcagtgagaaaaccaagaagatcaaggaggtcactgtccgaggtctggagcccgagatccagaagctgattgcaaggcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggttccagcagcacctggagcaggagcagtgggcgctgcagcagcaacggcagcggctgtacagtgaggtggctgaggagagggagcggctgggccagcaggcagccaggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggagcgcatgtccccccaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttca

SEQ ID NO: 116457 - DNA, 619 bp, Homo sapiens
  Payload ID: 2722
  Gene Symbol: CEP131
  Gene Name: centrosomal protein 131kDa
  ENST ID: ENST00000571292
  CDS Start-End: 1-619
tgaagcagcagctggagctggagaggcaggcgtgggaggccggccgcaccaggaaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggc

SEQ ID NO: 116458 - DNA, 1160 bp, Homo sapiens
  Payload ID: 2722
  Gene Symbol: CEP131
  Gene Name: centrosomal protein 131kDa
  ENST ID: ENST00000570817
  CDS Start-End: 1-923
gggcctcgcagcgctgcctgcgccaggccgaggagctgcgggagcagctggagcgggagaaggaggcgctgggccagcaggagcgcgaacgtgctcggcagcggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggtgagtccctgtggccagccctgctggacctcggggctgggagcaggcctgaccctgtgggtgtgctgcaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttca

SEQ ID NO: 116459 - DNA, 5562 bp, Homo sapiens
  Payload ID: 2723
  Gene Symbol: CEP135
  Gene Name: centrosomal protein 135kDa
  Uniprot ID: Q66GS9
  ENST ID: ENST00000257287
  CDS Start-End: 125-3547
gacggaaggagctagtgggggactcgaggcctgagggcaatgcggctggaggcggaggcaacggcggctggagctgccggactttaatttttggaagtgaataaaacttgttttagaagacgagatgactacagctgtagagagaaagtatattaatattaggaaaaggctggatcagctgggataccgccagactctgacagtggagtgtttacctttggtagaaaaacttttcagcgacttagttcatacaactgagagccttcggcaatcaaaattatctgctgtgaaagctgaaaaagaaagtgccaattttgattttgttttggaaccctataaacttgaaaatgcaagattgagtagagaaaataatgaattatacctagagttaatgaaactgagagaacattcagaccaacacgttaaagagttgaaaacttcattgaagaaatgtgcacgtgaaacagctgatctgaaatttctgaataaccaatatgctcataaactcaaactgttggagaaagagagcaaagctaagaatgaaagaattcaacaacttcaagaaaagaatttgcatgctgtagtacaaactccaggtggcaagaaaagaagtattgctttcaggcgccagcgtatgcaaattgatgaaccggttcctccctctgaagtcagttcatatccagttcctcaaccagatgacccttacattgcagacctccttcaagtggctgataacaggattcaagaacttcaacaggaagtccaccagctacaagaaaagttagcaatgatggaaagtggggtgagagactatagcaagcagattgagctaagagaacgagagatagaacgactgtcagttgctttggatggtggtcggtcccctgatgtcctttctctggagtctagaaataaaaccaatgaaaagcttattgctcatttaaatattcaggttgactttcttcagcaagctaataaagacctggagaagcgtatacgagagcttatggaaaccaaggaaacagtgacatctgaagtcgttaatttaagtaacaaaaatgaaaaactctgccaagaattaactgaaatagatcagttagcacagcagttggaaagacataaagaagaagtgcttgagactgctgataaagagcttggggaagcaaagaaagagattaaaagaaagctctctgaaatgcaggatcttgaagaaacaatggcaaaacttcagctggaattgaacttatgccagaaagaaaaggagagactgagtgatgaactccttgtaaaatcagacctagaaactgttgttcatcagcttgaacaagaaaagcaaagacttagcaaaaaagttgaaagttttgcagttacagaacgacaacttactctggaggttgagaggatgagactagaacatggaataaaacgtcgagacaggtcaccttctcgtttagatacatttctgaaaggtatagaagaagaacgagattattataagaaagagctagagagactccaacatataatacagcgaagatcttgctctacaagttatagcgcacgtgaaaaaagttcaatatttagaacaccagaaaagggtgattacaattcagaaattcatcagatcacaagagaaagagatgaacttcagcgtatgctagaaagatttgaaaaatatatggaagatatacagtccaatgttaaattattgacagcagaaagagataaactaagtgtcttatataatgaagctcaggaagaattatctgccctaagaaaggaatccacccaaaccacagcaccccataatattgttagtcttatggaaaaggaaaaagaacttgcgttatctgacttaagaagaattatggcagaaaaggaagctttaagagaaaaattagagcatattgaagaagtgagtctttttggaaaatcagaattagagaaaactattgaacatttgacatgtgttaatcatcagcttgaaagcgaaaaatatgaattaaagtctaaagtgttaataatgaaagaaacaatagagtcgttagagaacaaattaaaagtccaagctcaaaaatttagccatgtggctggtgactcatctcatcagaaaacagaggtgaactcacttaggatagtgaatgagcagctacagcggtcagttgatgactatcagcaccgactttccataaaaagaggtgaacttgaatcagcccaagcacaaattaaaatactggaggaaaagatagatgaactaaaccttaagatgacttcacaggatgaggaggctcatgtaatgaaaaagaccattggtgttattgataaagaaaaagactttctccaggagactgtagatgagaagacagaaaagattgcaaatttgcaagaaaacctagctaataaagaaaaagctgttgctcaaatgaagataatgatctcagagtgtgaatcatctgtgaaccagctgaaagaaacattggttaatcgagatcgtgagataaacagcctccggcgccagcttgatgcagctcacaaagaactcgatgaagtaggaagatctagagaaatcgcttttaaggaaaacagaagactgcaagatgacctggctacaatggcaagagaaaatcaagaaatctcattggaattggaagcagcagtgcaagaaaaagaagaaatgaagagcagagttcataaatacataacagaggtgtcacgatgggagagcttaatggctgccaaggaaaaagaaaatcaagatttgttagatagatttcagatgcttcataaccgtgctgaagactgggaggtcaaagcccatcaagctgagggagaaagcagctcagttcgactggaacttctttctattgacactgagaggagacatcttcgagaaagagtggagctattagaaaaagaaattcaagagcacataaatgcccatcatgcttatgaatctcagatctcatcaatggcaaaagccatgtctcgattagaagaagagctgagacatcaagaagatgagaaagcaacagtattaaatgacttgtcatctcttagagaactttgcattaaacttgattcaggcaaagatattatgacccagcaattgaattcgaaaaaccttgagtttgagagggttgtggtggaattagaaaatgtaaagtcagagtcagacctactgaaaaaacaactttcaaatgagagacatacagttaaaaacctcgaatcattgttggctacaaacagagataaagaatttcattctcacttaacctcccacgagaaggatacagaaatccagctacttaaggagaagttaaccctttctgaaagcaaattaactagtcaaagccgggaaaacaccatgcttcgagctaaagtggcacagttacaaacagattatgatgctctgaaaaggcagatctcaactgaaagatacgaacgagaacgagcaatccaagagatgcgtcgacatggtcttgctacaccaccccttagttccactctgaggtctccttcacattctcctgaacatagaaatgtgtaattatcagaaagaataatggctttcaatgagttcctatgtggatttttaaaagaacagaacagtaatgaaatatttgaagtacttgttgctgaaaatcatgaacatggacacaaattctacctctgtcaacttttatttaaatcagtgaatatgttaaaaagtttggtttaaaagaactatatctatatgtatattttcatatatatgacagaacaagaatatgtattaatagtgcctaatgtatctatatttttattattcatgaattaaattactaaaagtatgtttatactgtgaattaatataatgtattcacattattctttaataatctgtttattaataagccatgatatgtgtatgtaaatattcttacagtacttgtttttagttgtcatgcctatgtttagaccatatcttaatgtattcacaaagaattatcaactttgatgctatgctgtcatgcttaactttttcttcttaaaattattcatagatctactgtctgttgtcaaggggaatatattcaggtctagtcttcttataatagcagaggtcttggtaaaataactaccatatataacgtgttattgccatctagaagaactatgatgagaaagatacatttatatattatgtaaaatgttaactatcatcatatggactctatgtaacacaaattcaaaagcaaactaaaagctatatgcagagttttgtataaaacaatagaacagaaatttgggacatttttctaggaaataaaattcctcggtgtattaatctaaggtttcaaagtataaaagtatatggggtaggccgggtgcagtggctcacgcctgtaatcccagcactttgggaggccgaggcgagtggatttcctaaggtcaggagtttgagaccagcctgagcaatgtggtgaaaccccatctctactaaaaatacaaaaattatctgggcttggtggcgggcacctgtaatcccagccacttgggaggctgaggcaggagaattgcttgaacccgggaggtggaggctgcggtgagccaagatcatgccattgcactccagcctgggtgacagagtaacactctgtctcagaaaaaaaaaaaaagaaaaatatatggggtaaatacagtaaaacgttttgttaaattccaatatacattcagtgataccactctttttcttctaagcctgtgtgttataatttaccagttccccaaaatgccatttttaacgccgaactgtgtaatatacatggaaaacagctttttacaattaattttcaaagttgtaattttaaagaatttgggtgtatacctatgttaatgaaacaacagaagtacaaaaaagaatatcagatacaaaaatcaatcgtgaagaaaatctgttcttaatatatttcattatgattgaaaaacataaaaactaacataggaaagtgaatgatcagttacttatgatatattttgtttcctcttgtggtttaataaagtgaagtgtgtgtgtgtgtgtgtgtgtgtatacctgggggtgggcagtgctctttttctaaaactaatatggcttatatatctgaattatgccctttttagtgtgtattaggatgtgggctggtttgcttttctaccacctttgtaattttatgtatcccatctcctttgtgtgaattcatatattatagcaaaatacaagagacatgggactgtttgcaataccatatggaaatcttttaataaatatatgtaaataaaataaaaaatatttgtctccaccttttccccaaaagcaacagcaagacatattttgttagatattttatttttaatgttttctataatttaaaaatgtatagcctgccaaatgttgttttcataaccatgatattgttttgaaaaaattttatcttaaaatactgaatgttctgaccttttatagatgtttttgattttgttttaaataattttaaattatggagcttgacctagatttgccaataaactttctagcctatt

SEQ ID NO: 116460 - DNA, 2092 bp, Homo sapiens
  Payload ID: 2723
  Gene Symbol: CEP135
  Gene Name: centrosomal protein 135kDa
  Uniprot ID: Q66GS9
  ENST ID: ENST00000422247
  CDS Start-End: 235-984
aatcgtccgccgctcccgttaccggggcaaccgcggcgcctcctccgtgtcggccccgatcgtccctccgcgccattttcaaactgctctagcgccggagcccgtgcctggacggaaggagctagtgggggactcgaggcctgagggcaatgcggctggaggcggaggcaacggcggctggagctgccggactttaatttttggaagtgaataaaacttgttttagaagacgagatgactacagctgtagagagaaagtatattaatattaggaaaaggctggatcagctgggataccgccagactctgacagtggagtgtttacctttggtagaaaaacttttcagcgacttagttcatacaactgagagccttcggcaatcaaaattatctgctgtgaaagctgaaaaagaaagtgccaattttgattttgttttggaaccctataaacttgaaaatgcaagattgagtagagaaaataatgaattatacctagagttaatgaaactgagagaacattcagaccaacacgttaaagagttgaaaacttcattgaagaaatgtgcacgtgaaacagctgatctgaaatttctgaataaccaatatgctcataaactcaaactgttggagaaagagagcaaagctaagaatgaaagaattcaacaacttcaagaaaagaatttgcatgctgtagtacaaactccaggtggcaagaaaagaagtattgctttcaggcgccagcgtatgcaaattgatgaaccggttcctccctctgaagtcagttcatatccagttcctcaaccagatgacccttacattgcagacctccttcaagtggctgataacaggattcaagaacttcaacaggaagtccaccagctacaagaaaagttagcaatgatggaaagtggggtgagagactatagcaagcaggtaggatttttatttacttgcatagtagggattgagataggtatgctgtgattgtaaatagaattgggttatatttgaaattgctgatactgagtttttatacagctttcctctttttcatcaggtttgttaatagagttaatagctggaatggcttaggtggctttacttacttagcctgtctcttcaaaaaatttaaaaattagccaagtgtggtggcatgtgcctatggtcccaggtacttgggaggctgaggtgggaggattaatggattgaagagcacttatttactcgattctcttcactattcattgaggtgaatagtagttttttgtttggtttttcttttagctgaatcatctatctccccaaatataattttataaccatattaccgttttcatctcaggagacattttattaagtgtgctatgttttataattgtatttttgtgatttttctactcttattatatattttgtcatattgaacaccagtctcttagaaagttactcttttgtgttgctaatttttttgtttgttttctctataagcacaagtcctcatacaacagttttctgaagaatcaggagaattagtagatgcagagttatattataaccatagcaagctttgtcttttcataatttctattgatgtcttggctaaattttgatttgggtaattataggcttgttttcttaatatgcttcttgaaggttaaattgggtaacatgtttttcattttctgcattgactgcattttttttgagtgatctgcacacacaaatatagatgtaacttaggtgttggtataactaaatctttaaagtgttttgaagattagttggataaaaatggagttaaagaaaattgaccaggcgtggtggctcatgcctgtaatcgcagcactttgggaggccgaggcgggtggatcacttgagatcagaagtttgagaccatcctggccaacatggtgaaacctcatctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctc

SEQ ID NO: 116461 - DNA, 4986 bp, Homo sapiens
  Payload ID: 2724
  Gene Symbol: CEP152
  Gene Name: centrosomal protein 152kDa
  Uniprot ID: O94986
  ENST ID: ENST00000325747
  CDS Start-End: 78-3905
gggatctgctagaagttggtcttccgccaggactagagtttcctcgcggtaacagcctccgtggcctccggaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaagaaggatgaaaaaagcattgaggttgagactaaaacagatacctcagaaaaaccaaagaatcaattatggcctgagtcttctacttctgatgttgtcagagatgatattctgctgcttaaaaatgaaattcaagttttacaacaacaaaatcaggaacttaaagaaactgaaggaaaactgagaaatacaaatcaagacttatgtaatcaaatgagacaaatggtacaagattttgaccatgacaaacaagaagctgtggataggtgtgaaaggacttatcagcagcaccatgaagccatgaaaactcaaatacgtgaaagcctattagcaaagcatgctttggagaagcagcagctctttgaggcttatgagagaactcatttgcaactgaggtctgagttggataagttgaataaggaggtgactgctgtgcaggaatgttacctagaagtgtgcagagagaaggataatctagaattgactctcaggaagaccactgaaaaggagcaacagactcaggagaagatcaaagaaaaactcattcaacagcttgaaaaggagtggcagtctaagctggatcaaactataaaggcaatgaaaaagaagaccttagattgtggcagccaaactgaccaagtaaccaccagtgatgttatttccaagaaagagatggcaattatgatagaagagcagaagtgcacaatccagcaaaacttagaacaagagaaggacatagccatcaagggggctatgaagaaactcgaaattgaattggaactcaaacattgtgaaaatattaccaaacaggtagaaatagctgtgcaaaatgctcatcagcgatggctgggagaactaccagagctggcagagtatcaagcacttgtgaaggcagaacagaaaaagtgggaagaacagcatgaggtctctgtgaacaaaaggatatcatttgctgtttctgaagctaaagagaaatggaagagtgagcttgaaaatatgaggaaaaatatacttcctggaaaggaattggaagagaagattcattctcttcagaaggaacttgagttaaagaacgaagaagtccctgtggtcatcagggctgagttagctaaggctcggagtgaatggaacaaagaaaagcaagaagaaatccacagaatccaagaacaaaatgagcaagattaccggcaatttttagatgatcaccgaaataaaattaatgaggtgcttgcggcagctaaagaagactttatgaaacaaaaaactgaactacttcttcagaaggagacagaattacaaacttgtctagaccagagtcgtagagaatggactatgcaggaagccaagcggatccaactggaaatctatcagtatgaggaagacatcctgactgtacttggggttcttttaagtgatacccaaaaggagcacatcagtgattctgaggacaagcagcttttggaaatcatgtcgacttgttcttcaaaatggatgtctgtgcaatattttgaaaaactaaagggctgcatacagaaagcatttcaagatacacttcctctgcttgtagaaaacgctgacccagaatggaaaaagagaaatatggccgagctctctaaggattctgccagccagggcactggccaaggagaccctggacctgctgctggacaccatgctcagcccttggccttacaagcaacagaagcagaagctgataagaaaaaggtccttgaaattaaggatttatgctgtggacactgcttccaagaacttgaaaaggcaaagcaggaatgtcaagatctgaaaggaaaactggagaaatgctgtaggcatcttcagcatttagaaaggaagcacaaagctgtagtggaaaaaattggagaagagaataataaagttgttgaagaattaatagaagaaaacaacgacatgaagaataaattggaagaattgcaaacactttgtaaaacaccaccaaggtcattgtcagcaggggccattgaaaatgcttgcctgccatgcagtgggggagccttggaagaacttcgtgggcagtacattaaagctgtaaaaaaaattaaatgtgacatgcttcgttatattcaggagagtaaggaacgagctgcagaaatggtaaaagcagaggtactgcgagaacgtcaagaaaccgcccgaaagatgcgcaaatattatttgatttgcctccaacagattttgcaggatgatggaaaagaaggggctgagaaaaagattatgaatgctgctagcaaacttgctacaatggcaaaattactggaaacacctatttctagtaagtcccaaagcaaaactacacagtcaggtatgtcaaagtgagtcgccaaatggtttttctatcttttcttctttagctatttaatattttcagtatgaagaaggcagggaaggtaaggagtgagagttaatttgtgaagttttgtatgttttacttaaactagaagtttacgcaaaaagagtacacagtttccaatttaagtaggcagactgagcatgcccatcagtttcctattgctgcttccatccctcgaaatgatagaaaagattttaaacagcaaataaagaatgagaaaaagaagaaattataagtgggttttaaaaagttgcagtgggccaggcatcatggctcacacctgtaatcccagcactttgggaggctgaggtgggaggatcccttgatcccaggaatttgaggttgcagtaagctatgattgtgccactgtactccagcctgggtgacagagtgaggccctgtctcaaaaaaaaaaaaaaaaagtttgcagtggatagaccagaagctacaagaaatccctgagagaaagaagacagtataggatggaagatggaaacctcagttcaaaaccaccgggagatgactattgcaattaggagcaatatcaaaactgttccacatatgagggtgatatgttccaggagaaatagagggcctaggggatatgaatggggtaattagttggtgttctaaaccaacagcaaccaggtggggttaatcctctctttatttcttcttctcccctcctttccccaacctcaatattgagctgggcaacaacaacaggaacaaagaatctgggagcagggcagtgctccaggtggctagccatatcaagcaggaactgggagccgacttgccttgggaggctgagatgggaggatcacttgagtccgggaggtcaaggctgcagtgagctgtgatcgcaccactgcactccagcctgggaaacagagcagaccctgtctcaaaaaaaaaaaaaaaaaaaaaaaaaaaagtaagagtaaccaacaaaaacatagaacgtataactttaaaactggtaaaggaaaaacttggaaaaaaacattttcaatctaacaaaatcaggaaagaggaaaaaaacct

SEQ ID NO: 116462 - DNA, 5635 bp, Homo sapiens
  Payload ID: 2724
  Gene Symbol: CEP152
  Gene Name: centrosomal protein 152kDa
  Uniprot ID: O94986
  ENST ID: ENST00000380950
  CDS Start-End: 189-5321
ccgggcgagcttctagtcggcgattgaaggatgcgagtgctccttaagggcctccgccccgtgagttcggttgtgactaggaaggagctagtggactagagccagggtaaggggatctgctagaagttggtcttccgccaggactagagtttcctcgcggtaacagcctccgtggcctccggaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggctataatgaaattcagagtttatatgctggagaaaaatgtggtaatgtctgggaagaaaatagaagtaaaactgaagaccgacatcctgtgtaccatcctgaagaaggtggagatgaaggtggaagtggttatagtcctccaagtaaatgtgaacagactgatttatatcaccttcctgaaaactttaggccatataccaatggtcagaagcaggaatttaataaccaagcaaccaatgtaattaaattttcagatcctcaatggaaccattttcagggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaagaaggatgaaaaaagcattgaggttgagactaaaacagatacctcagaaaaaccaaagaatcaattatggcctgagtcttctacttctgatgttgtcagagatgatattctgctgcttaaaaatgaaattcaagttttacaacaacaaaatcaggaacttaaagaaactgaaggaaaactgagaaatacaaatcaagacttatgtaatcaaatgagacaaatggtacaagattttgaccatgacaaacaagaagctgtggataggtgtgaaaggacttatcagcagcaccatgaagccatgaaaactcaaatacgtgaaagcctattagcaaagcatgctttggagaagcagcagctctttgaggcttatgagagaactcatttgcaactgaggtctgagttggataagttgaataaggaggtgactgctgtgcaggaatgttacctagaagtgtgcagagagaaggataatctagaattgactctcaggaagaccactgaaaaggagcaacagactcaggagaagatcaaagaaaaactcattcaacagcttgaaaaggagtggcagtctaagctggatcaaactataaaggcaatgaaaaagaagaccttagattgtggcagccaaactgaccaagtaaccaccagtgatgttatttccaagaaagagatggcaattatgatagaagagcagaagtgcacaatccagcaaaacttagaacaagagaaggacatagccatcaagggggctatgaagaaactcgaaattgaattggaactcaaacattgtgaaaatattaccaaacaggtagaaatagctgtgcaaaatgctcatcagcgatggctgggagaactaccagagctggcagagtatcaagcacttgtgaaggcagaacagaaaaagtgggaagaacagcatgaggtctctgtgaacaaaaggatatcatttgctgtttctgaagctaaagagaaatggaagagtgagcttgaaaatatgaggaaaaatatacttcctggaaaggaattggaagagaagattcattctcttcagaaggaacttgagttaaagaacgaagaagtccctgtggtcatcagggctgagttagctaaggctcggagtgaatggaacaaagaaaagcaagaagaaatccacagaatccaagaacaaaatgagcaagattaccggcaatttttagatgatcaccgaaataaaattaatgaggtgcttgcggcagctaaagaagactttatgaaacaaaaaactgaactacttcttcagaaggagacagaattacaaacttgtctagaccagagtcgtagagaatggactatgcaggaagccaagcggatccaactggaaatctatcagtatgaggaagacatcctgactgtacttggggttcttttaagtgatacccaaaaggagcacatcagtgattctgaggacaagcagcttttggaaatcatgtcgacttgttcttcaaaatggatgtctgtgcaatattttgaaaaactaaagggctgcatacagaaagcatttcaagatacacttcctctgcttgtagaaaacgctgacccagaatggaaaaagagaaatatggccgagctctctaaggattctgccagccagggcactggccaaggagaccctggacctgctgctggacaccatgctcagcccttggccttacaagcaacagaagcagaagctgataagaaaaaggtccttgaaattaaggatttatgctgtggacactgcttccaagaacttgaaaaggcaaagcaggaatgtcaagatctgaaaggaaaactggagaaatgctgtaggcatcttcagcatttagaaaggaagcacaaagctgtagtggaaaaaattggagaagagaataataaagttgttgaagaattaatagaagaaaacaacgacatgaagaataaattggaagaattgcaaacactttgtaaaacaccaccaaggtcattgtcagcaggggccattgaaaatgcttgcctgccatgcagtgggggagccttggaagaacttcgtgggcagtacattaaagctgtaaaaaaaattaaatgtgacatgcttcgttatattcaggagagtaaggaacgagctgcagaaatggtaaaagcagaggtactgcgagaacgtcaagaaaccgcccgaaagatgcgcaaatattatttgatttgcctccaacagattttgcaggatgatggaaaagaaggggctgagaaaaagattatgaatgctgctagcaaacttgctacaatggcaaaattactggaaacacctatttctagtaagtcccaaagcaaaactacacagtcagcactgcccctaacttcagagatgctgattgcagttaaaaaatcaaaaagaaatgatgtgaatcagaaaataccatgttgtattgaaagcaaatcaaatagtgtaaacaccatcaccagaactctgtgcgaacaagctcccaagaggagggcagcttgtaacttacaaaggctgttagagaactcagagcatcagagcataaagcatgtgggatccaaagagacacatttggaattccagtttggggatggtagttgcaagcacctaaacagtttgccaaggaatgtttctcctgagtttgttccttgtgaaggtgaaggaggctttggtttgcacaagaagaaagacctactcagtgataatggttctgaatcacttccgcattcagctgcatacccctttcttggaaccttaggaaataaaccctcacctagatgtacccctggtccttctgaatcaggatgcatgcatataacctttcgcgattctaatgaaagacttggtttaaaagtatataaatgcaatccactaatggaaagtgaaaatgctgcatctgagaaaagtcaaggtttggatgttcaggaacctccagtaaaagatggaggggaccttagtgactgcttgggctggccttccagcagtgcaaccttatcctttgacagtcgtgaagcatcatttgtacatggtaggccacaaggaactttggaaataccaagtgaatctgttaaatccaaacagttttcaccatccggttatctttcagatacagaggaaagtaatatgatttgtcaaacaatgaaatgtcagcgttatcaaactccatacctgtcagaagaaaccacgtatttggagccaggaaagatcagtgtgaattgtggacacccatctcgtcataaggctgatagattaaagtcagatttcaaaaaactgagcagtacattaccatcttcagtgtgtcagcagccttcaagaaaattaattgttccgctatctagccaacaagatagtggctttgatagcccatttgttaatctagactaattatggtacagtatttaagaagaatcattaatatattaacaaaaatggaagggaagacctcatactgaaaaaaattgtgagccctgcctcttttgagatgttttaataacatctgttatataagtaaagcattcttctaaaattgcttgagatatttatgttgccttaatattccaaaggcctgatggtgtatgtataatctgcttttgtgtggtgcttatttttggtttctaaaccatctatttttatacttataaattgactcactctgcagtgttaacttatttaaataaacttgcatatggtctgtagaa

SEQ ID NO: 116463 - DNA, 5097 bp, Homo sapiens
  Payload ID: 2724
  Gene Symbol: CEP152
  Gene Name: centrosomal protein 152kDa
  Uniprot ID: O94986
  ENST ID: ENST00000399334
  CDS Start-End: 35-4999
tcgcggtaacagcctccgtggcctccggaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggctataatgaaattcagagtttatatgctggagaaaaatgtggtaatgtctgggaagaaaatagaagtaaaactgaagaccgacatcctgtgtaccatcctgaagaaggtggagatgaaggtggaagtggttatagtcctccaagtaaatgtgaacagactgatttatatcaccttcctgaaaactttaggccatataccaatggtcagaagcaggaatttaataaccaagcaaccaatgtaattaaattttcagatcctcaatggaaccattttcagggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaagaaggatgaaaaaagcattgaggttgagactaaaacagatacctcagaaaaaccaaagaatcaattatggcctgagtcttctacttctgatgttgtcagagatgatattctgctgcttaaaaatgaaattcaagttttacaacaacaaaatcaggaacttaaagaaactgaaggaaaactgagaaatacaaatcaagacttatgtaatcaaatgagacaaatggtacaagattttgaccatgacaaacaagaagctgtggataggtgtgaaaggacttatcagcagcaccatgaagccatgaaaactcaaatacgtgaaagcctattagcaaagcatgctttggagaagcagcagctctttgaggcttatgagagaactcatttgcaactgaggtctgagttggataagttgaataaggaggtgactgctgtgcaggaatgttacctagaagtgtgcagagagaaggataatctagaattgactctcaggaagaccactgaaaaggagcaacagactcaggagaagatcaaagaaaaactcattcaacagcttgaaaaggagtggcagtctaagctggatcaaactataaaggcaatgaaaaagaagaccttagattgtggcagccaaactgaccaagtaaccaccagtgatgttatttccaagaaagagatggcaattatgatagaagagcagaagtgcacaatccagcaaaacttagaacaagagaaggacatagccatcaagggggctatgaagaaactcgaaattgaattggaactcaaacattgtgaaaatattaccaaacaggtagaaatagctgtgcaaaatgctcatcagcgatggctgggagaactaccagagctggcagagtatcaagcacttgtgaaggcagaacagaaaaagtgggaagaacagcatgaggtctctgtgaacaaaaggatatcatttgctgtttctgaagctaaagagaaatggaagagtgagcttgaaaatatgaggaaaaatatacttcctggaaaggaattggaagagaagattcattctcttcagaaggaacttgagttaaagaacgaagaagtccctgtggtcatcagggctgagttagctaaggctcggagtgaatggaacaaagaaaagcaagaagaaatccacagaatccaagaacaaaatgagcaagattaccggcaatttttagatgatcaccgaaataaaattaatgaggtgcttgcggcagctaaagaagactttatgaaacaaaaaactgaactacttcttcagaaggagacagaattacaaacttgtctagaccagagtcgtagagaatggactatgcaggaagccaagcggatccaactggaaatctatcagtatgaggaagacatcctgactgtacttggggttcttttaagtgatacccaaaaggagcacatcagtgattctgaggacaagcagcttttggaaatcatgtcgacttgttcttcaaaatggatgtctgtgcaatattttgaaaaactaaagggctgcatacagaaagcatttcaagatacacttcctctgcttgtagaaaacgctgacccagaatggaaaaagagaaatatggccgagctctctaaggattctgccagccagggcactggccaaggagaccctggacctgctgctggacaccatgctcagcccttggccttacaagcaacagaagcagaagctgaagagaataataaagttgttgaagaattaatagaagaaaacaacgacatgaagaataaattggaagaattgcaaacactttgtaaaacaccaccaaggtcattgtcagcaggggccattgaaaatgcttgcctgccatgcagtgggggagccttggaagaacttcgtgggcagtacattaaagctgtaaaaaaaattaaatgtgacatgcttcgttatattcaggagagtaaggaacgagctgcagaaatggtaaaagcagaggtactgcgagaacgtcaagaaaccgcccgaaagatgcgcaaatattatttgatttgcctccaacagattttgcaggatgatggaaaagaaggggctgagaaaaagattatgaatgctgctagcaaacttgctacaatggcaaaattactggaaacacctatttctagtaagtcccaaagcaaaactacacagtcagcactgcccctaacttcagagatgctgattgcagttaaaaaatcaaaaagaaatgatgtgaatcagaaaataccatgttgtattgaaagcaaatcaaatagtgtaaacaccatcaccagaactctgtgcgaacaagctcccaagaggagggcagcttgtaacttacaaaggctgttagagaactcagagcatcagagcataaagcatgtgggatccaaagagacacatttggaattccagtttggggatggtagttgcaagcacctaaacagtttgccaaggaatgtttctcctgagtttgttccttgtgaaggtgaaggaggctttggtttgcacaagaagaaagacctactcagtgataatggttctgaatcacttccgcattcagctgcatacccctttcttggaaccttaggaaataaaccctcacctagatgtacccctggtccttctgaatcaggatgcatgcatataacctttcgcgattctaatgaaagacttggtttaaaagtatataaatgcaatccactaatggaaagtgaaaatgctgcatctgagaaaagtcaaggtttggatgttcaggaacctccagtaaaagatggaggggaccttagtgactgcttgggctggccttccagcagtgcaaccttatcctttgacagtcgtgaagcatcatttgtacatggtaggccacaaggaactttggaaataccaagtgaatctgttaaatccaaacagttttcaccatccggttatctttcagatacagaggaaagtaatatgatttgtcaaacaatgaaatgtcagcgttatcaaactccatacctgtcagaagaaaccacgtatttggagccaggaaagatcagtgtgaattgtggacacccatctcgtcataaggctgatagattaaagtcagatttcaaaaaactgagcagtacattaccatcttcagtgtgtcagcagccttcaagaaaattaattgttccgctatctagccaacaagatagtggctttgatagcccatttgttaatctagactaattatggtacagtatttaagaagaatcattaatatattaacaaaaatggaagggaagacctcatactgaaaaaaattgtgagccctgcctcttttgaga

SEQ ID NO: 116464 - DNA, 1947 bp, Homo sapiens
  Payload ID: 2724
  Gene Symbol: CEP152
  Gene Name: centrosomal protein 152kDa
  ENST ID: ENST00000560322
  CDS Start-End: 194-1947
gcccaccgggcgagcttctagtcggcgattgaaggatgcgagtgctccttaagggcctccgccccgtgagttcggttgtgactaggaaggagctagtggactagagccagggtaaggggatctgctagaagttggtcttccgccaggactagagtttcctcgcggtaacagcctccgtggcctccggaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggctataatgaaattcagagtttatatgctggagaaaaatgtggtaatgtctgggaagaaaatagaagtaaaactgaagaccgacatcctgtgtaccatcctgaagaaggtggagatgaaggtggaagtggttatagtcctccaagtaaatgtgaacagactgatttatatcaccttcctgaaaactttaggccatataccaatggtcagaagcaggaatttaataaccaagcaaccaatgtaattaaattttcagatcctcaatggaaccattttcagggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaa

SEQ ID NO: 116465 - DNA, 577 bp, Homo sapiens
  Payload ID: 2724
  Gene Symbol: CEP152
  Gene Name: centrosomal protein 152kDa
  ENST ID: ENST00000561245
  CDS Start-End: 1-195
gcccgaaagatgcgcaaatattatttgatttgcctccaacagattttgcaggatgatggaaaagaaggggctgagaaaaagattatgaatgctgctagcaaacttgctacaatggcaaaattactggaaacacctatttctagtgaagaagctaagtctcagaaagataactcacccaagaggacacaaggataaacctgatacccatggcagtagaaagcctacacttacccactcagatgctcatcaatggaggagagacttatgcctggaggaacttggaaatcaaactcagtacaatagctcacacctgtaatcccagcactttgggaggctaacgtgggcaaatcacttgagcccaggagttcccgaccaacctgggcaacatggtgaaaccccatttctacaaaaaaaatacaaaaattaggtgggcgtgatggcatgcacctgcagtcccagctacttgggaggctgaggcaggaggatacttgagcccaggagttcaatgctgcagtgagccatgatcatgccactgcactccagcctgtgtgacagagcaagaccctgtctctattta

SEQ ID NO: 116466 - DNA, 588 bp, Homo sapiens
  Payload ID: 2724
  Gene Symbol: CEP152
  Gene Name: centrosomal protein 152kDa
  ENST ID: ENST00000558591
  CDS Start-End: 384-588
agccccgggcatcctgggccccgtgcggctttggtcatgtttgtagtgccgtagctgacgccaaacagttcctcaaggtcattcgctcagcctgtggatgcttattgtgtattagcattactcgctccgccctctgggcaacttgaatcaatttgtccaaagtgctgttattagcactgatcacaagatgttgtgatcatttgtttatatgtctattttctttcccttcatcgtgtcctgttaaactttgtaatcttgaacagtgcttggtaaattgtcgaatgaatgaataaggtgtctccaccaggtgttgcaagtctaaaccgggctatgtgctctggctatttccattctagaaggcgagttatgtcagcaagaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctg

SEQ ID NO: 116467 - DNA, 5063 bp, Homo sapiens
  Payload ID: 2725
  Gene Symbol: CEP162
  Gene Name: centrosomal protein 162kDa
  Uniprot ID: Q5TB80
  ENST ID: ENST00000257766
  CDS Start-End: 251-4234
ggaattcagaggcagagctttcagatgattcttttgaaaattcagacaaaacagctagacaatctaaaaaagagatgaagaagaaagatacagtgccttggtggataactgaagatgattttaaagatgatgttatctactgaactccgggttattcctcctcattcctcaaagattttagctgctgtttcactgacttcttggaacaaatgtgagctatttgaaaacaaagaagacttctcagcctgttatggaaatagaagaggagtctgctgaaaagattcaatttcttaagagcagtggaacctctctcttaagtactgatagcttagaaacaaatgaactagtagtttctgagctcaaccatagtagtctcggagtgggattggacacattagaagaacaagaggagaaagaacaattttttgccaggcttgagaaaggcttgacatcttccattgattattcgagattaaataaggaattggattctaatgactctacacattttaaagctttacatagtaatcaagccaacgcagaactaactgatgacgaacatgagaatgaatcgaaacatgaagaactggcagaaaattacagtgatgattttgaagatgagtatgttggtgcaccgttgactactaaagatgaagagatgccttccaaagagaattccaaatcagaaaaaataagtgtgcccaaacaggaagaagaaaaaactggcatgcttgctaatgttgtgctgcttgattcattagactctgttgcagaggtcaatcttgatgaacaagataaaataacacctaagccaaggtgcctaccagaaatgactgagaatgaaatgacaggaacaggtgtttcttatggacaaagcagtagtgacgttgaagccctacatcaagcttattgtcatatagcccattcattgggagatgaagacaaacaaaaaattgagagtaacacagtggaagatatcaagagctcagtgaaaggtcatcctcaagaaaatgaagagaattcaaaaaacatctctactatggaatctgatctgcccacagtagaggagctgatgaaacctatcagaatagattcctttgggatcagtggttttgatttacaacctgtcagctctgagaaagtggccgaaagaaaagaaactgaattttttagctctttacccctgaagatgaacccaaatattttgtctcaagactcacaacatgtgaaccttttttttgacaaaaatgatgagaatgtgattttacaaaagaccacaaatgagagtatggaaaacagctgtccacaagtaactgaagtaactgccacagaagaacatgttgataaaatgtaccttaatattttgaggaaaaaaataactgttaattcttcatcattatctcaggatgacaaaattaataaaacttacagatctcaacttagttctgaagaagaaggggctgtaatgggtaaacaggtaccatacaagaaggccagaagtgcacctcctttacttaaaaggaaaccccagagtggattatatgcgtcagttaggagctcaggctatggcaaacccagttcaccactcaagatgttttctactcttgaaaagaaaacttcagaggacattataaaaagcaaaaacttgagatcgatttctacctccaatcaacctaggaaaaaagaaatcttatctggaacaaaactcatcaagcctgcagctttggataaaccagctcacaaaactgaaagttgcctgtctactcgtaagaagtctgaaaatcccacagaaactgattcctgtattcagtttcagactgattccttaggatactgtggtgagaacaaggagaagaaattacttatgtttaaaagagttcaggaagcagaggataaatggaggggtgcgcaagccctaattgagcaaattaaagccacattctcagaaaaggagaaagaactagaaaataagttggaagaactaaagaaacaacaggaaaaagaactcttcaaattgaatcaagataattatattcttcaagccaagttaagcagctttgaagaaacaaacaaaaaacaaaggtggttacattttggagaagcagctgatcctgtcactggagaaaagttgaagcaaatccaaaaagaaatacaagaacaagagacacttcttcaaggatatcaacaggaaaatgaacgattatataatcaagtaaaagatctccaagaacaaaacaagaaaaatgaggagcgaatgtttaaggaaaaccaaagtttattcagtgaggtagcttccttaaaagaacagatgcacaaaagtcgttttctgtctcaagtagttgaagattcagagcccacaagaaatcagaattttacagatctgttagcagaactacggatggcacagaaagaaaaagacagtttattggaagacatcaaaagactgaaacaagacaaacaagctcttgaagtagacttcgaaaaaatgaagaaagagagggaccaagccaaagatcagattgcttatgtcacaggtgagaaattatatgaaataaaaattttagaagaaacacataaacaagaaatcagtcgtctgcaaaaaagattacagtggtatgctgaaaatcaggaacttctggataaagatgcacttcggcttagagaagcaaatgaggaaattgagaagctcaaacttgagattgagaaactgaaagctgaatctgggaatccatctattcggcagaagatacgcttaaaagataaagcagcagatgccaaaaaaattcaggatctggagcgacaagttaaggaaatggaagggattctgaagagaagatatcccaattctttacctgctttaatattggctgcatcagcagctggtgatacagtggataaaaatacagtggaatttatggagaaaaggataaaaaagctagaagctgatctggagggcaaagatgaagatgcaaagaaaagccttcgtaccatggaacaacagtttcagaaaatgaagattcagtatgaacaaagactagagcagcaggagcagctacttgcctgcaaattgaatcaacatgactctcccagaattaaagccctagagaaggaacttgatgacatcaaggaagcccatcagatcactgtaagaaaccttgaagccgaaatagacgttcttaaacatcagaatgctgaattagacgtcaagaaaaatgataaagatgatgaagattttcagtctatagaattccaggtggaacaggctcatgctaaagctaaattagtaagactcaatgaagaactggctgcaaaaaagagagaaatacaagacctctcaaaaactgtggagaggcttcagaaagacagaagaatgatgctatcaaatcagaactcaaagggcagagaggaaatgtctgccaaaagggcaaagaaagatgttttgcactcaagtaaaggaaatgctaactccttccctggaaccctggacagcaagctgtaccaaccacatactttcactgattcccatgtttcagaagttttacaagaaaactacagattaaaaaatgagctagaaggattaatttcagagaagaatgaactgaagatgaaatctgaagcagtgatgaatcaatttgaaaactccatgagaagggtcaaggaagatactgcagcacacattgcatccctcaaagcatctcatcagagagaaatagagaaactcctttgccaaaatgcagtagaaaattcttcttccaaagtagctgaactaaatcgtaaaatagcaactcaagaggtacttataagacatttccaaagtcaagttaatgagctgcagagtaaacaagagtctctcgtagtttctgaagttcgagaagaaattctacagaaagagattacaaaactcttagaagaattgagagaagccaaagaaaaccatacaccagagatgaaacatttcgtgggcttagaaaagaaaattaagcagatggaaatgagacatgcacaaagagaacaggaacttcaacagataatacagcaaacacaccaagtagtagaaactgagcaaaacaaagaagttgaaaaatggaaaagactggcacagttaaagaatcgtgagctggagaagttccgcacagaactagactcaatattagatgttctccgagagctgcaccggcaaggagtggttgtgccagttgcttttgcagatgaaatgaatgcaccagagtattaatagaaattcagatttcataatgaccttattaaaaggcctgaagatggatgggattgtgccactgtcaggacagcttatgaaaaacaagtgttccaatatgtttccagaaagcaaacaaccaaagcaacatttcaaaataaattgcctttaaccaataagaaaaaaaacatataatggtgtattttactaaaaatcattaaccagtctcattttaagtgatttatggacagtttcctttatagcagagaagggctcacttgtatgctagaaatagaaagaaaagaaaattgaacatactccgccacatttttattgataatgtgaggtttttaaaatttttattttagatccagggggtacatgtgcttgttgtaacatgggtgtattgaataatggtgggaattgggcttctagtgtacccatcatccaaatattaaacactgtacccaacaggtaatttttcaacgcttactgccgctcacactctttcccctattggagtccccagtgtctgttatctccatctttatgtctctgtgtacccattgtttagctcctacttttaagtgagaatatatgcaatattttattttttatgtctgatttagttcacataggataatggcctccagctctatccatgttgctgcaaatgacatgatttcattcttttttatagttgcataatactccatttatatatctctctctatatatatctcacgttttctttatccagtcaattgttggtagatacttaggttggttccatgaatttgctattgtaaatattgctgcaataaacatacatgtacagatatctttttta

SEQ ID NO: 116468 - DNA, 5156 bp, Homo sapiens
  Payload ID: 2725
  Gene Symbol: CEP162
  Gene Name: centrosomal protein 162kDa
  Uniprot ID: Q5TB80
  ENST ID: ENST00000403245
  CDS Start-End: 116-4327
gacaactggtggacccgcacagaccttccgggaaagcgcggaattcagaggcagagtgtttccaatgtttgaggtactttagaatgtttactttgggaggtcaaaattgttgactatggctaactgttcccaagaagagctagatgaagagtttgaacagtttatgaaagagctttcagatgattcttttgaaaattcagacaaaacagctagacaatctaaaaaagagatgaagaagaaagatacagtgccttggtggataactgaagatgattttaaagatgatggacttcttggaacaaatgtgagctatttgaaaacaaagaagacttctcagcctgttatggaaatagaagaggagtctgctgaaaagattcaatttcttaagagcagtggaacctctctcttaagtactgatagcttagaaacaaatgaactagtagtttctgagctcaaccatagtagtctcggagtgggattggacacattagaagaacaagaggagaaagaacaattttttgccaggcttgagaaaggcttgacatcttccattgattattcgagattaaataaggaattggattctaatgactctacacattttaaagctttacatagtaatcaagccaacgcagaactaactgatgacgaacatgagaatgaatcgaaacatgaagaactggcagaaaattacagtgatgattttgaagatgagtatgttggtgcaccgttgactactaaagatgaagagatgccttccaaagagaattccaaatcagaaaaaataagtgtgcccaaacaggaagaagaaaaaactggcatgcttgctaatgttgtgctgcttgattcattagactctgttgcagaggtcaatcttgatgaacaagataaaataacacctaagccaaggtgcctaccagaaatgactgagaatgaaatgacaggaacaggtgtttcttatggacaaagcagtagtgacgttgaagccctacatcaagcttattgtcatatagcccattcattgggagatgaagacaaacaaaaaattgagagtaacacagtggaagatatcaagagctcagtgaaaggtcatcctcaagaaaatgaagagaattcaaaaaacatctctactatggaatctgatctgcccacagtagaggagctgatgaaacctatcagaatagattcctttgggatcagtggttttgatttacaacctgtcagctctgagaaagtggccgaaagaaaagaaactgaattttttagctctttacccctgaagatgaacccaaatattttgtctcaagactcacaacatgtgaaccttttttttgacaaaaatgatgagaatgtgattttacaaaagaccacaaatgagagtatggaaaacagctgtccacaagtaactgaagtaactgccacagaagaacatgttgataaaatgtaccttaatattttgaggaaaaaaataactgttaattcttcatcattatctcaggatgacaaaattaataaaacttacagatctcaacttagttctgaagaagaaggggctgtaatgggtaaacaggtaccatacaagaaggccagaagtgcacctcctttacttaaaaggaaaccccagagtggattatatgcgtcagttaggagctcaggctatggcaaacccagttcaccactcaagatgttttctactcttgaaaagaaaacttcagaggacattataaaaagcaaaaacttgagatcgatttctacctccaatcaacctaggaaaaaagaaatcttatctggaacaaaactcatcaagcctgcagctttggataaaccagctcacaaaactgaaagttgcctgtctactcgtaagaagtctgaaaatcccacagaaactgattcctgtattcagtttcagactgattccttaggatactgtggtgagaacaaggagaagaaattacttatgtttaaaagagttcaggaagcagaggataaatggaggggtgcgcaagccctaattgagcaaattaaagccacattctcagaaaaggagaaagaactagaaaataagttggaagaactaaagaaacaacaggaaaaagaactcttcaaattgaatcaagataattatattcttcaagccaagttaagcagctttgaagaaacaaacaaaaaacaaaggtggttacattttggagaagcagctgatcctgtcactggagaaaagttgaagcaaatccaaaaagaaatacaagaacaagagacacttcttcaaggatatcaacaggaaaatgaacgattatataatcaagtaaaagatctccaagaacaaaacaagaaaaatgaggagcgaatgtttaaggaaaaccaaagtttattcagtgaggtagcttccttaaaagaacagatgcacaaaagtcgttttctgtctcaagtagttgaagattcagagcccacaagaaatcagaattttacagatctgttagcagaactacggatggcacagaaagaaaaagacagtttattggaagacatcaaaagactgaaacaagacaaacaagctcttgaagtagacttcgaaaaaatgaagaaagagagggaccaagccaaagatcagattgcttatgtcacaggtgagaaattatatgaaataaaaattttagaagaaacacataaacaagaaatcagtcgtctgcaaaaaagattacagtggtatgctgaaaatcaggaacttctggataaagatgcacttcggcttagagaagcaaatgaggaaattgagaagctcaaacttgagattgagaaactgaaagctgaatctgggaatccatctattcggcagaagatacgcttaaaagataaagcagcagatgccaaaaaaattcaggatctggagcgacaagttaaggaaatggaagggattctgaagagaagatatcccaattctttacctgctttaatattggctgcatcagcagctggtgatacagtggataaaaatacagtggaatttatggagaaaaggataaaaaagctagaagctgatctggagggcaaagatgaagatgcaaagaaaagccttcgtaccatggaacaacagtttcagaaaatgaagattcagtatgaacaaagactagagcagcaggagcagctacttgcctgcaaattgaatcaacatgactctcccagaattaaagccctagagaaggaacttgatgacatcaaggaagcccatcagatcactgtaagaaaccttgaagccgaaatagacgttcttaaacatcagaatgctgaattagacgtcaagaaaaatgataaagatgatgaagattttcagtctatagaattccaggtggaacaggctcatgctaaagctaaattagtaagactcaatgaagaactggctgcaaaaaagagagaaatacaagacctctcaaaaactgtggagaggcttcagaaagacagaagaatgatgctatcaaatcagaactcaaagggcagagaggaaatgtctgccaaaagggcaaagaaagatgttttgcactcaagtaaaggaaatgctaactccttccctggaaccctggacagcaagctgtaccaaccacatactttcactgattcccatgtttcagaagttttacaagaaaactacagattaaaaaatgagctagaaggattaatttcagagaagaatgaactgaagatgaaatctgaagcagtgatgaatcaatttgaaaactccatgagaagggtcaaggaagatactgcagcacacattgcatccctcaaagcatctcatcagagagaaatagagaaactcctttgccaaaatgcagtagaaaattcttcttccaaagtagctgaactaaatcgtaaaatagcaactcaagaggtacttataagacatttccaaagtcaagttaatgagctgcagagtaaacaagagtctctcgtagtttctgaagttcgagaagaaattctacagaaagagattacaaaactcttagaagaattgagagaagccaaagaaaaccatacaccagagatgaaacatttcgtgggcttagaaaagaaaattaagcagatggaaatgagacatgcacaaagagaacaggaacttcaacagataatacagcaaacacaccaagtagtagaaactgagcaaaacaaagaagttgaaaaatggaaaagactggcacagttaaagaatcgtgagctggagaagttccgcacagaactagactcaatattagatgttctccgagagctgcaccggcaaggagtggttgtgccagttgcttttgcagatgaaatgaatgcaccagagtattaatagaaattcagatttcataatgaccttattaaaaggcctgaagatggatgggattgtgccactgtcaggacagcttatgaaaaacaagtgttccaatatgtttccagaaagcaaacaaccaaagcaacatttcaaaataaattgcctttaaccaataagaaaaaaaacatataatggtgtattttactaaaaatcattaaccagtctcattttaagtgatttatggacagtttcctttatagcagagaagggctcacttgtatgctagaaatagaaagaaaagaaaattgaacatactccgccacatttttattgataatgtgaggtttttaaaatttttattttagatccagggggtacatgtgcttgttgtaacatgggtgtattgaataatggtgggaattgggcttctagtgtacccatcatccaaatattaaacactgtacccaacaggtaatttttcaacgcttactgccgctcacactctttcccctattggagtccccagtgtctgttatctccatctttatgtctctgtgtacccattgtttagctcctacttttaagtgagaatatatgcaatattttattttttatgtctgatttagttcacataggataatggcctccagctctatccatgttgctgcaaatgacatgatttcattcttttttatagttgcataatactccatttatatatctctctctatatatatctcacgttttctttatccagtcaattgttggtagatacttaggttggttccatgaatttgctattgtaaatattgctgcaataaacatacatgtacagatatctttttta

SEQ ID NO: 116469 - DNA, 586 bp, Homo sapiens
  Payload ID: 2725
  Gene Symbol: CEP162
  Gene Name: centrosomal protein 162kDa
  ENST ID: ENST00000435955
  CDS Start-End: 98-316
acagaccttccgggaaagcgcggaattcagaggcagagtgtttccaatgtttgaggtactttagaatgtttactttgggaggtcaaaattgttgactatggctaactgttcccaagaagagctagatgaagagtttgaacagtttatgaaagagctttcagatgattcttttgaaaattcagacaaaacagctagacaatctaaaaaagagatgaagaagaaagatacagtgccttggtggataactgaagatgattttaaagatgatggcattattatgaaaaggcaagacgtgattcctgtatcaagagtgtagaaccttctgagggagaattcaacactcctcttgagaagaggaatgcattattaatcttaagacaggacttcttggaacaaatgtgagctatttgaaaacaaagaagacttctcagcctgttatggaaatagaagaggagtctgctgaaaagattcaatttcttaagagcagtggaacctctctcttaagtactgatagcttagaaacaaatgaactagtagtttctgagctcaaccatagtagtctcggagtgggattggacacattaga

SEQ ID NO: 116470 - DNA, 5095 bp, Homo sapiens
  Payload ID: 2725
  Gene Symbol: CEP162
  Gene Name: centrosomal protein 162kDa
  Uniprot ID: Q5TB80
  ENST ID: ENST00000617909
  CDS Start-End: 284-4267
gacaactggtggacccgcacagaccttccgggaaagcgcggaattcagaggcagagctttcagatgattcttttgaaaattcagacaaaacagctagacaatctaaaaaagagatgaagaagaaagatacagtgccttggtggataactgaagatgattttaaagatgatggtaaatgttgctttctttgaacataaatcttcatctgtattaaattgtgtacctaggacttcttggaacaaatgtgagctatttgaaaacaaagaagacttctcagcctgttatggaaatagaagaggagtctgctgaaaagattcaatttcttaagagcagtggaacctctctcttaagtactgatagcttagaaacaaatgaactagtagtttctgagctcaaccatagtagtctcggagtgggattggacacattagaagaacaagaggagaaagaacaattttttgccaggcttgagaaaggcttgacatcttccattgattattcgagattaaataaggaattggattctaatgactctacacattttaaagctttacatagtaatcaagccaacgcagaactaactgatgacgaacatgagaatgaatcgaaacatgaagaactggcagaaaattacagtgatgattttgaagatgagtatgttggtgcaccgttgactactaaagatgaagagatgccttccaaagagaattccaaatcagaaaaaataagtgtgcccaaacaggaagaagaaaaaactggcatgcttgctaatgttgtgctgcttgattcattagactctgttgcagaggtcaatcttgatgaacaagataaaataacacctaagccaaggtgcctaccagaaatgactgagaatgaaatgacaggaacaggtgtttcttatggacaaagcagtagtgacgttgaagccctacatcaagcttattgtcatatagcccattcattgggagatgaagacaaacaaaaaattgagagtaacacagtggaagatatcaagagctcagtgaaaggtcatcctcaagaaaatgaagagaattcaaaaaacatctctactatggaatctgatctgcccacagtagaggagctgatgaaacctatcagaatagattcctttgggatcagtggttttgatttacaacctgtcagctctgagaaagtggccgaaagaaaagaaactgaattttttagctctttacccctgaagatgaacccaaatattttgtctcaagactcacaacatgtgaaccttttttttgacaaaaatgatgagaatgtgattttacaaaagaccacaaatgagagtatggaaaacagctgtccacaagtaactgaagtaactgccacagaagaacatgttgataaaatgtaccttaatattttgaggaaaaaaataactgttaattcttcatcattatctcaggatgacaaaattaataaaacttacagatctcaacttagttctgaagaagaaggggctgtaatgggtaaacaggtaccatacaagaaggccagaagtgcacctcctttacttaaaaggaaaccccagagtggattatatgcgtcagttaggagctcaggctatggcaaacccagttcaccactcaagatgttttctactcttgaaaagaaaacttcagaggacattataaaaagcaaaaacttgagatcgatttctacctccaatcaacctaggaaaaaagaaatcttatctggaacaaaactcatcaagcctgcagctttggataaaccagctcacaaaactgaaagttgcctgtctactcgtaagaagtctgaaaatcccacagaaactgattcctgtattcagtttcagactgattccttaggatactgtggtgagaacaaggagaagaaattacttatgtttaaaagagttcaggaagcagaggataaatggaggggtgcgcaagccctaattgagcaaattaaagccacattctcagaaaaggagaaagaactagaaaataagttggaagaactaaagaaacaacaggaaaaagaactcttcaaattgaatcaagataattatattcttcaagccaagttaagcagctttgaagaaacaaacaaaaaacaaaggtggttacattttggagaagcagctgatcctgtcactggagaaaagttgaagcaaatccaaaaagaaatacaagaacaagagacacttcttcaaggatatcaacaggaaaatgaacgattatataatcaagtaaaagatctccaagaacaaaacaagaaaaatgaggagcgaatgtttaaggaaaaccaaagtttattcagtgaggtagcttccttaaaagaacagatgcacaaaagtcgttttctgtctcaagtagttgaagattcagagcccacaagaaatcagaattttacagatctgttagcagaactacggatggcacagaaagaaaaagacagtttattggaagacatcaaaagactgaaacaagacaaacaagctcttgaagtagacttcgaaaaaatgaagaaagagagggaccaagccaaagatcagattgcttatgtcacaggtgagaaattatatgaaataaaaattttagaagaaacacataaacaagaaatcagtcgtctgcaaaaaagattacagtggtatgctgaaaatcaggaacttctggataaagatgcacttcggcttagagaagcaaatgaggaaattgagaagctcaaacttgagattgagaaactgaaagctgaatctgggaatccatctattcggcagaagatacgcttaaaagataaagcagcagatgccaaaaaaattcaggatctggagcgacaagttaaggaaatggaagggattctgaagagaagatatcccaattctttacctgctttaatattggctgcatcagcagctggtgatacagtggataaaaatacagtggaatttatggagaaaaggataaaaaagctagaagctgatctggagggcaaagatgaagatgcaaagaaaagccttcgtaccatggaacaacagtttcagaaaatgaagattcagtatgaacaaagactagagcagcaggagcagctacttgcctgcaaattgaatcaacatgactctcccagaattaaagccctagagaaggaacttgatgacatcaaggaagcccatcagatcactgtaagaaaccttgaagccgaaatagacgttcttaaacatcagaatgctgaattagacgtcaagaaaaatgataaagatgatgaagattttcagtctatagaattccaggtggaacaggctcatgctaaagctaaattagtaagactcaatgaagaactggctgcaaaaaagagagaaatacaagacctctcaaaaactgtggagaggcttcagaaagacagaagaatgatgctatcaaatcagaactcaaagggcagagaggaaatgtctgccaaaagggcaaagaaagatgttttgcactcaagtaaaggaaatgctaactccttccctggaaccctggacagcaagctgtaccaaccacatactttcactgattcccatgtttcagaagttttacaagaaaactacagattaaaaaatgagctagaaggattaatttcagagaagaatgaactgaagatgaaatctgaagcagtgatgaatcaatttgaaaactccatgagaagggtcaaggaagatactgcagcacacattgcatccctcaaagcatctcatcagagagaaatagagaaactcctttgccaaaatgcagtagaaaattcttcttccaaagtagctgaactaaatcgtaaaatagcaactcaagaggtacttataagacatttccaaagtcaagttaatgagctgcagagtaaacaagagtctctcgtagtttctgaagttcgagaagaaattctacagaaagagattacaaaactcttagaagaattgagagaagccaaagaaaaccatacaccagagatgaaacatttcgtgggcttagaaaagaaaattaagcagatggaaatgagacatgcacaaagagaacaggaacttcaacagataatacagcaaacacaccaagtagtagaaactgagcaaaacaaagaagttgaaaaatggaaaagactggcacagttaaagaatcgtgagctggagaagttccgcacagaactagactcaatattagatgttctccgagagctgcaccggcaaggagtggttgtgccagttgcttttgcagatgaaatgaatgcaccagagtattaatagaaattcagatttcataatgaccttattaaaaggcctgaagatggatgggattgtgccactgtcaggacagcttatgaaaaacaagtgttccaatatgtttccagaaagcaaacaaccaaagcaacatttcaaaataaattgcctttaaccaataagaaaaaaaacatataatggtgtattttactaaaaatcattaaccagtctcattttaagtgatttatggacagtttcctttatagcagagaagggctcacttgtatgctagaaatagaaagaaaagaaaattgaacatactccgccacatttttattgataatgtgaggtttttaaaatttttattttagatccagggggtacatgtgcttgttgtaacatgggtgtattgaataatggtgggaattgggcttctagtgtacccatcatccaaatattaaacactgtacccaacaggtaatttttcaacgcttactgccgctcacactctttcccctattggagtccccagtgtctgttatctccatctttatgtctctgtgtacccattgtttagctcctacttttaagtgagaatatatgcaatattttattttttatgtctgatttagttcacataggataatggcctccagctctatccatgttgctgcaaatgacatgatttcattcttttttatagttgcataatactccatttatatatctctctctatatatatctcacgttttctttatccagtcaattgttggtagatacttaggttggttccatgaatttgctattgtaaatattgctgcaataaacatacatgtacagatatctttttt

SEQ ID NO: 116471 - DNA, 5630 bp, Homo sapiens
  Payload ID: 2726
  Gene Symbol: CEP164
  Gene Name: centrosomal protein 164kDa
  Uniprot ID: Q9UPV0
  ENST ID: ENST00000278935
  CDS Start-End: 148-4530
ttgcgcgctgcagggcaacaccccggcgtccctggaagctgggggagcgggagaaataactttatttggactgagagctggagaatgagaataggacctgagagtatattgggctaaggaggagaggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaaggacagagacccccccaaaagttcgctggccttgggttcctcattagccccagttcatgttcctcttgggggcctggctcctttacgaggtcttgtggataccccaccctctgctcttcgtggatctcaaagcgtgagcctggggagctcagtggagtctggacgtcagcttggagaactcatgctgccttcacagggtctcaagacctctgcttatacaaagggtctcttgggctccatatatgaggacaagactgctctcagcctcttgggtttaggagaagaaaccaatgaggaggatgaggaggaaagtgacaaccagagtgtccacagctcaagtgagcctcttaggaacctacacctggacattggggcactggggggtgactttgagtatgaggagtctctgagaacaagccagccagaggagaagaaggatgtttctctggattcagatgctgccggtccccctactccctgcaagccctccagcccaggtgcagacagcagtctgagcagtgctgttggcaaagggcgacagggaagtggagcaagacctggtcttccagaaaaagaggaaaatgagaagagtgaacctaagatttgcaggaatctggtgacccccaaggcagaccctacaggcagtgagcctgccaaagcctctgaaaaggaagcaccagaggacacagtagatgcaggagaggagggttccaggagggaagaggcagccaaggagccaaagaagaaggcttctgctctggaagagggcagttcagacgccagccaagaactggaaattagtgaacacatgaaggaaccacagctctcagactccatagcttctgaccccaagtccttccatggcctggacttcggttttcgcagccggatctcggagcacctgctggatgttgatgtgctttccccagtcctgggtggagcttgtcggcaggcccagcaaccactgggaatagaagacaaggatgacagccagtccagccaagatgagctgcagagcaagcagtccaaaggcctggaggagaggttatctcctccacttccacacgaggagcgggcccagagtccccctcgcagcctggccactgaagaagagcctccccagggccccgaggggcagcccgagtggaaggaggcagaggagcttggggaggactctgcagccagcctcagcctgcagctgtccctccagagggagcaggccccaagcccacctgctgcctgtgagaagggcaaggagcagcattcccaggccgaggagctgggccctgggcaggaagaggcagaggatcctgaggagaaggtggcggtcagccccaccccgccagtctctccagaggtgcgatccacagagcctgtggctcccccagagcagctctcagaggctgcactaaaggccatggaagaggcagtggcccaagtactcgagcaagaccagaggcacctgctggaatccaagcaagagaagatgcagcaactgcgggagaagctgtgccaagaggaggaagaggagatcctccggcttcaccagcagaaagagcaatctctcagttccttgagggagcggctgcagaaagccattgaggaggaggaggcccggatgagagaggaggaaagccagaggctatcctggctccgagctcaggtccagtccagcacacaagcagatgaggaccaaatcagggctgagcaagaggcttccctgcagaaactgagagaagagttggagtctcaacagaaggctgagagggccagcttggaacagaaaaataggcaaatgctggagcagctcaaggaagagatagaggcttcggagaagagcgagcaggctgccctgaatgctgcaaaggagaaggctctgcagcagctgagggagcagctggaaggggagaggaaagaagctgtggcaacgctggagaaggagcacagtgctgagctggagcggctctgctcctcattggaggccaagcaccgggaggtggtctccagcctccagaagaagatacaggaagctcaacagaaagaggaggcccagctgcagaagtgccttgggcaagtggagcacagagttcaccagaagtcttatcacgtggctgggtatgagcacgagctcagcagtctcctgcgagagaagcgccaggaagtggaaggggagcatgagaggaggttggacaagatgaaggaggagcaccagcaagtgatggctaaggccagagagcagtatgaagctgaggagaggaagcagcgggctgagcttctggggcacctgaccggagagctggagcgcctgcagagggcccatgaacgagaactggagactgtgaggcaggagcaacacaagcgtcttgaggacttgcggcgccggcacagggagcaggaaaggaagctccaggatttagagttggaccttgaaaccagagctaaagatgtcaaggccagattggctctgctggaggtccaggaggagaccgcccggagggagaagcagcagctgcttgatgtgcagaggcaggttgctctgaagagtgaggaagccacagccacccatcagcagctggaggaggcacagaaggagcacacccacctgttgcagtcaaaccagcagctccgagaaattcttgatgagctgcaggcccgcaagctgaagctggagtcccaagtggatctgctgcaggctcagagccagcaactgcagaaacacttcagcagcctggaggctgaagctcaaaagaagcagcacctgttgagagaagtgacagttgaggaaaataatgcttccccacattttgagccagatctccatattgaggacctgaggaaatcccttggaacaaaccagaccaaagaggtgtcttcttctctctcccagagcaaggaggacttatacttggacagcctgtcctcccacaatgtctggcacctcctctctgctgagggggtagccctccgtagtgccaaggagttccttgtgcagcagacacgctccatgcggaggcggcagacagctctgaaagctgcccagcagcattggcgccatgagctggccagtgcgcaggaggtggccaaagacccaccaggcatcaaggccctggaagatatgcgcaagaacctggagaaggagaccaggcacctggatgagatgaagtcggccatgcggaaaggccacaacctgctgaagaagaaagaggagaagctgaatcagttggagtcctctctttgggaagaggcctcagatgagggcactctgggaggatcccccaccaagaaggcagtaaccttcgacctcagtgacatggacagcctgagcagtgaaagttctgaatctttttccccgcctcaccgtgagtggtggcggcagcagaggatcgactcaaccccgagtctcacctcccgcaagatccacgggcttagccactccctccggcagatcagcagccagctgagcagtgtcctcagcatcctggacagcctcaaccctcagtcgccgccgccgctcctcgcctccatgccagcccagctccctccccgggaccctaagagcacccccacccccacctactatggctccctggccaggttctcagccttatcatctgctacacccacgtccacccaatgggcctgggattcagggcaggggcccaggctcccctcctctgtggctcaaacggtggacgacttcctgttggagaagtggcgcaagtattttccatctggcatcccgctgctcagcaacagccccaccccgctggagagcaggctgggttacatgtctgccagtgagcagctccggctcctacagcactcccattcgcaagtccctgaggcgggcagcaccacctttcagggcataattgaggccaaccggaggtggctggaacgtgtcaagaatgaccccaggttacctctcttctcgtcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatataacctatctcaggctaaaatgtgtggactcgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggactgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacaacttctccaggaggccaaaaaaagactgggttggcttctggtcctcatgatggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgtttttttttttgcaagc

SEQ ID NO: 116472 - DNA, 492 bp, Homo sapiens
  Payload ID: 2726
  Gene Symbol: CEP164
  Gene Name: centrosomal protein 164kDa
  ENST ID: ENST00000533570
  CDS Start-End: 128-492
ggactgagggaagaagtgaaaatcggactgccaggcgacagttcctccgtttgaaatctcgccggctcctgagcgggccaccgggcccgggctgggggtctggcgggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaa

SEQ ID NO: 116473 - DNA, 778 bp, Homo sapiens
  Payload ID: 2726
  Gene Symbol: CEP164
  Gene Name: centrosomal protein 164kDa
  ENST ID: ENST00000525416
  CDS Start-End: 413-778
agctgcgcctcgcccagagcctcgcccggagcctcgcccggagccttccggggtgggggatagttgaggacctcatcgagggaggggttgggcggcggggaagggagcgagcgtggcgggggacccgaggcacgctctcgagccaacgagcgtgatgcgctcgagtgtgggcggggactgagggaagaagtgaaaatcggactgccaggcgacagttcctccgtttgaaatctcgccggctcctgagcgggccaccgggcccgggctgggggtctggcgggagaaataactttatttggactgagagctggagaatgagaataggacctgagagtatattgggctaaggaggagagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaaggacagagacccccccaaaagttcgctggccttgggttcctcattagccccagttcatgttcctcttgggggcctggctcctttacgaggtcttgtggataccccaccctctgctcttcgtggatctcaaagcgtgagc

SEQ ID NO: 116474 - DNA, 585 bp, Homo sapiens
  Payload ID: 2726
  Gene Symbol: CEP164
  Gene Name: centrosomal protein 164kDa
  ENST ID: ENST00000533153
  CDS Start-End: 112-585
gtttgttgcgcgctgcagggcaacaccccggcgtccctggaagctgggggagcggaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaaggacagagacccccccaaaagttcgctggccttgggttcctcattagccccagttcatgttcctcttgggggcctggctcctttacgaggtcttgtggataccccaccctctgctcttcgtggatctcaaagcgtgagcctggggagctcagtggagtctggacgtcagcttggagaactcatgctgccttcacagggtctcaagacctctgcttatacaaagggtctcttgggctccatatatgag

SEQ ID NO: 116475 - DNA, 585 bp, Homo sapiens
  Payload ID: 2726
  Gene Symbol: CEP164
  Gene Name: centrosomal protein 164kDa
  ENST ID: ENST00000527609
  CDS Start-End: 222-585
gcgctcgagtgtgggcggggactgagggaagaagtgaaaatcggactgccaggcgacagttcctccgtttgaaatctcgccggctcctgagcgggccaccgggcccgggctgggggtctggcgggagaaataactttatttggactgagagctggagaatgagaataggacctgagagtatattgggctaaggaggagaggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaaga

SEQ ID NO: 116476 - DNA, 616 bp, Homo sapiens
  Payload ID: 2726
  Gene Symbol: CEP164
  Gene Name: centrosomal protein 164kDa
  ENST ID: ENST00000525734
  CDS Start-End: 270-616
gatcagattcaaggtgacacgcaccagcatacacagaaccacagggctgcccgggcccggactgccccacagaggcggcagatgcacacagaggtcagccacagcaccccacatggagggctgctcacccacagaggtgcagagggtgccacctccaccagccaccttgaaggagaaataactttatttggactgagagctggagaatgagaataggacctgagagtatattgggctaaggaggagaggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaa

SEQ ID NO: 116477 - DNA, 6705 bp, Homo sapiens
  Payload ID: 2727
  Gene Symbol: CEP170B
  Gene Name: centrosomal protein 170B
  Uniprot ID: Q9Y4F5
  ENST ID: ENST00000414716
  CDS Start-End: 229-4893
gtgggctcggcccgggctgccacgagcgtgcgggcctcgccgggcatgtcctaggcggcggccccgcccagcgctcggccgggcgggcgggcgggcgcgagggcagggaccgagccgggccgagctggggaacaagccggggaccaagccggggaccaagccggggactaaggcgagccggagaccgagcccgaacagcagggccagacgggcccagccagcaccaagatgagtgccacgtcctggttcctggtgagcagcagcggcgcccgccaccggctccctcgggagctcatcttcgtggggcgtgaggagtgtgagctcatgctacagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgcttcggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcaggcagtgcccgatacacctccaccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggcagcacgctggagcctgtcaccttg

SEQ ID NO: 116478 - DNA, 6813 bp, Homo sapiens
  Payload ID: 2727
  Gene Symbol: CEP170B
  Gene Name: centrosomal protein 170B
  ENST ID: ENST00000453495
  CDS Start-End: 229-5001
gtgggctcggcccgggctgccacgagcgtgcgggcctcgccgggcatgtcctaggcggcggccccgcccagcgctcggccgggcgggcgggcgggcgcgagggcagggaccgagccgggccgagctggggaacaagccggggaccaagccggggaccaagccggggactaaggcgagccggagaccgagcccgaacagcagggccagacgggcccagccagcaccaagatgagtgccacgtcctggttcctggtgagcagcagcggcgcccgccaccggctccctcgggagctcatcttcgtggggcgtgaggagtgtgagctcatgctacagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgcttcggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagcagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcaggcagtgcccgatacacctccaacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggcagcacgctggagcctgtcaccttg

SEQ ID NO: 116479 - DNA, 6683 bp, Homo sapiens
  Payload ID: 2727
  Gene Symbol: CEP170B
  Gene Name: centrosomal protein 170B
  Uniprot ID: Q9Y4F5
  ENST ID: ENST00000556508
  CDS Start-End: 340-4899
cccgcgcgcgaggccgccggcggccgctctgccgtgggctcggcccgggctgccacgagcgtgcgggcctcgccgggcatgtcctaggcggcggccccgcccagcgctcggccgggcgggcgggcgggcgcgagggcagggaccgagccgggccgagctggggaacaagccggggaccaagccggggaccaagccggggactaaggcgagccggagaccgagcccgaacagcagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgcttcggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcaggcagtgcccgatacacctccaacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcaca

SEQ ID NO: 116480 - DNA, 5961 bp, Homo sapiens
  Payload ID: 2728
  Gene Symbol: CEP170
  Gene Name: centrosomal protein 170kDa
  ENST ID: ENST00000336415
  CDS Start-End: 1-4676
tacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtaagtcaaactgcttttatgattgcattctttgatgaagacaatcccagaaaaagaaggtcgtattcttttactcaaagtgcgggaatcttgtgtcaggaaactacatattcaacaccacatacaaaacttgagaaagcaaagtctccaacagcagatgccaaagtggtttctttgtctttacagactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatctta

SEQ ID NO: 116481 - DNA, 6828 bp, Homo sapiens
  Payload ID: 2728
  Gene Symbol: CEP170
  Gene Name: centrosomal protein 170kDa
  Uniprot ID: Q5SW79
  ENST ID: ENST00000366542
  CDS Start-End: 53-4807
cacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttta

SEQ ID NO: 116482 - DNA, 6727 bp, Homo sapiens
  Payload ID: 2728
  Gene Symbol: CEP170
  Gene Name: centrosomal protein 170kDa
  Uniprot ID: Q5SW79
  ENST ID: ENST00000366543
  CDS Start-End: 324-4706
ttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttta

SEQ ID NO: 116483 - DNA, 6805 bp, Homo sapiens
  Payload ID: 2728
  Gene Symbol: CEP170
  Gene Name: centrosomal protein 170kDa
  Uniprot ID: Q5SW79
  ENST ID: ENST00000366544
  CDS Start-End: 324-4784
ttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttta

SEQ ID NO: 116484 - DNA, 789 bp, Homo sapiens
  Payload ID: 2728
  Gene Symbol: CEP170
  Gene Name: centrosomal protein 170kDa
  ENST ID: ENST00000413359
  CDS Start-End: 1-789
acacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacattggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatg

SEQ ID NO: 116485 - DNA, 3031 bp, Homo sapiens
  Payload ID: 2728
  Gene Symbol: CEP170
  Gene Name: centrosomal protein 170kDa
  ENST ID: ENST00000481987
  CDS Start-End: 513-1475
attcatattttcactcaagtaagaaatatttgcaattgaaaagtactccagttaaacatcgatggatagagcttgcttagttgtttatcattagcgaaatttttcatctgaatgtttactcaccacactatggaaaacatggtcttccaattgtttttgattcttcattgtttttaattcaccgaagtgtaatgtttctatctctaaggagtagtagacttatggtttttgtgaggtatgtgtacgtcagttattgaaaattgtgccgtgtgtgcgctctcatggtgttttgaagtcatgacttttattttacctcctttaaatgataacataataattctttttttaataattaaactaatttagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaat

SEQ ID NO: 116486 - DNA, 741 bp, Homo sapiens
  Payload ID: 2728
  Gene Symbol: CEP170
  Gene Name: centrosomal protein 170kDa
  ENST ID: ENST00000464936
  CDS Start-End: 215-741
agtgtgggaggccagctgttacaacggacatgaagatgtgtgattattttcagtaggcagacatctaataaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacattggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaa

SEQ ID NO: 116487 - DNA, 561 bp, Homo sapiens
  Payload ID: 2728
  Gene Symbol: CEP170
  Gene Name: centrosomal protein 170kDa
  ENST ID: ENST00000522191
  CDS Start-End: 162-561
gtcatgcaccctgcctggcgactgcaccccgtggaggctctggctctgtagtaaacccgggggaggagagagtggcttcctgtcggcttcattgtcctaggattcagatgtagggttttggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctg

SEQ ID NO: 116488 - DNA, 593 bp, Homo sapiens
  Payload ID: 2728
  Gene Symbol: CEP170
  Gene Name: centrosomal protein 170kDa
  ENST ID: ENST00000523424
  CDS Start-End: 261-593
atgtgctccctgagtaggctgtgactatcactgaacttgattctcaccgtgattaatctagttcttgcctttgtgatgtaaaagtagtaatcctcctaaaatggacctttactttcataaagtaacttactacatgaggaaagatgtcctaacatgtgcttttcataaaaacgaagtgttgcagtgttttccctactacctaatggtagctacttaacggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaag

SEQ ID NO: 116489 - DNA, 608 bp, Homo sapiens
  Payload ID: 2728
  Gene Symbol: CEP170
  Gene Name: centrosomal protein 170kDa
  ENST ID: ENST00000522995
  CDS Start-End: 344-608
gtgtggcgcctgcgcagtaagggatcgttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagat

SEQ ID NO: 116490 - DNA, 642 bp, Homo sapiens
  Payload ID: 2728
  Gene Symbol: CEP170
  Gene Name: centrosomal protein 170kDa
  ENST ID: ENST00000461671
  CDS Start-End: 1-358
aaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgcca

SEQ ID NO: 116491 - DNA, 616 bp, Homo sapiens
  Payload ID: 2728
  Gene Symbol: CEP170
  Gene Name: centrosomal protein 170kDa
  ENST ID: ENST00000522895
  CDS Start-End: 1-520
tgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatggtattctctttctctctttcattctttatcccttttttcttctctttctccatttctctctctttctcttactcttctctgcttttttgtgaatcatatatcagttgttattataaaaaacaagccaaatctatatagtaagaagtaagttaaacctaaataaacatattcacatattctcatgctga

SEQ ID NO: 116492 - DNA, 609 bp, Homo sapiens
  Payload ID: 2728
  Gene Symbol: CEP170
  Gene Name: centrosomal protein 170kDa
  ENST ID: ENST00000492145
  CDS Start-End: 300-609
tgaagatgtgtgattattttcagtaggcagacatctaagtaagccctaagtcttgagttaagagtggaggggaagttgatatgaaatttcatctttttatttttgattggtttacatctaccacaccatctcctacaagaccctaaaggaacataaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacattggttgatcgtgtttttgatgaaagcctcaacttccgaaagattcctccattagttcattccaaaacaccagaaggaaacaacggtcgatctggtgatccaagacctcaagcagcagagcctc

SEQ ID NO: 116493 - DNA, 1070 bp, Homo sapiens
  Payload ID: 2728
  Gene Symbol: CEP170
  Gene Name: centrosomal protein 170kDa
  ENST ID: ENST00000490813
  CDS Start-End: 85-966
aacggacatgaagatgtgtgattattttcagtaggcagacatctaaccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacattggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaa

SEQ ID NO: 116494 - DNA, 6804 bp, Homo sapiens
  Payload ID: 2728
  Gene Symbol: CEP170
  Gene Name: centrosomal protein 170kDa
  Uniprot ID: Q5SW79
  ENST ID: ENST00000450306
  CDS Start-End: 324-4784
ttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 116495 - DNA, 6828 bp, Homo sapiens
  Payload ID: 2728
  Gene Symbol: CEP170
  Gene Name: centrosomal protein 170kDa
  Uniprot ID: Q5SW79
  ENST ID: ENST00000612450
  CDS Start-End: 54-4808
ccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 116496 - DNA, 6457 bp, Homo sapiens
  Payload ID: 2728
  Gene Symbol: CEP170
  Gene Name: centrosomal protein 170kDa
  Uniprot ID: Q5SW79
  ENST ID: ENST00000621831
  CDS Start-End: 54-4436
ccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttta

SEQ ID NO: 116497 - DNA, 7764 bp, Homo sapiens
  Payload ID: 2729
  Gene Symbol: CEP192
  Gene Name: centrosomal protein 192kDa
  ENST ID: ENST00000325971
  CDS Start-End: 1296-7484
agtgccctgggacacctcttcagtccgtggactttcccgctgcacactgccctccgaagtcggggacgcgggctcgtgagatggaagattttcgaggtatagcagaagaatcatttccaagctttctcaccaattcattatttggtaacagtgggattttggaaaatgtcactctttcttcaaatcttggcttgcctgttgctgtttctacacttgctagggatagatccagcactgataacaggtatcctgatatccaggcatcttacttagtagaagggagattttcagttccatccgggtcatctcccggaagccagagtgatgctgaaccaagagagaggttacagcttagcttccaggatgatgattctatctctaggaaaaagagctatgtggaaagtcaacgtttgtcaaatgctctcagcaaacagtcagctttacaaatggagacagcaggaccagaagaggagccagccggagctacagaatccttgcagggccaagatctcttcaacagggcttcaccactggaacaagcacaagactcacctattgattttcatttacagtcatggatgaataataaggaacccaagattgttgtgcttgatgctggaaaacattttgaagacaagactctaaagagtgacctaagccacactagcttattagaaaatgagaaacttatcttaccgacaagcttggaagattcttctgatgatgatattgatgatgaaatgttttatgatgatcatttggaggcttattttgaacaactggcaattccaggaatgatatatgaagacctagaaggaccagaacctccagaaaaaggttttaagttacctacaaatggtcttagacaggcaaatgaaaacggtagcttaaactgcaagtttcaatcagaaaataacagctctctgatttccctcgactcacactcttctgaaacaactcacaaagagtctgaggaaagccaagttatttgtctacctgggactagtaattctataggtactggagatagtagaaggtacacagatggtatgttaccattttcctctggtacttggggaactgagaaagaaatagaaaatttgaagggtattgttccagatcttaacagtgaatgtgcaagtaaagatgttctggtgaagaccctcagggctattgatgtgaaacttaactctgataattttcatgatgcaaatgccaatagaggtggttttgatctgactgaccctgtaaaacagggggcagagtgtcctcaccaaaataagacagttttgcacatggatggatgtttagacactgagactcctacggtgtccattcaagaaaatgtggatgtagcctctttgaagcccattagtgacagtggaattaatttcactgatgccatttggtcaccaacttgtgaaaggcgaacatgtgaatgtcacgagtccatcgaaaagaataaagacaaaacagatctcccacagagtgtggtctatcaaaatgaagagggtaggtgggtcacagaccttgcctattacacatcttttaatagcaaacaaaatttaaatgtgtctctaagtgatgagatgaatgaagacttcagatctggttctgaagcatttgatttgattgcacaagatgaagaagaatttaataaagagcatcaatttatacagccatcatttggctattttattagatcaccagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcgctgtttcacgttttccaaggaatccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctactccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaatgtggtatatccag

SEQ ID NO: 116498 - DNA, 3286 bp, Homo sapiens
  Payload ID: 2729
  Gene Symbol: CEP192
  Gene Name: centrosomal protein 192kDa
  ENST ID: ENST00000430049
  CDS Start-End: 375-1655
ctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcgctgtttcacgttttccaaggaatccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctactccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcaggcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaacaggcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatatttt

SEQ ID NO: 116499 - DNA, 6548 bp, Homo sapiens
  Payload ID: 2729
  Gene Symbol: CEP192
  Gene Name: centrosomal protein 192kDa
  ENST ID: ENST00000510237
  CDS Start-End: 1-5796
aagacagttttgcacatggatggatgtttagacactgagactcctacggtgtccattcaagaaaatgtggatgtagcctctttgaagcccattagtgacagtggaattaatttcactgatgccatttggtcaccaacttgtgaaaggcgaacatgtgaatgtcacgagtccatcgaaaagaataaagacaaaacagatctcccacagagtgtggtctatcaaaatgaagagggtaggtgggtcacagaccttgcctattacacatcttttaatagcaaacaaaatttaaatgtgtctctaagtgatgagatgaatgaagacttcagatctggttctgaagcatttgatttgattgcacaagatgaagaagaatttaataaagagcatcaatttatacaggaagaaaacatagatgctcataatacttcggttgcactgggcgatacgtcctggggagctacaattaattacagtctgttgaggaaatcacgtagcacatcagatttggataaagatgatgccagttatttacgtctgtctttaggagagttctttgctcaaagatctgaagctcttggttgccttggtggtggtaacaatgtgaaaagaccatcatttggctattttattagatcaccagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcgctgtttcacgttttccaaggaatccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctactccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagagatggagcctcaccacactgcccaggctggtctcgatctcctgacctcaagcaatcttcccacctcagcctcccaaagtgctgggattacagggagttgatgaaagtggagatgtttttagagctacctatgcagcattcagatgttctcctatttctggtctgctggaaagccatgggatccaaaaacaggcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaatgtggtatatccag

SEQ ID NO: 116500 - DNA, 8635 bp, Homo sapiens
  Payload ID: 2729
  Gene Symbol: CEP192
  Gene Name: centrosomal protein 192kDa
  ENST ID: ENST00000513432
  CDS Start-End: 1-1223
caaatgctctcagcaaacagtcagctttacaaatggagacagcaggaccagaagaggagccagccggagctacagaatccttgcagggccaagatctcttcaacagggcttcaccactggaacaagcacaagactcacctattgattttcatttacagtcatggatgaataataaggaacccaagattgttgtgcttgatgctggaaaacattttgaagacaagactctaaagagtgacctaagccacactagcttattagaaaatgagaaacttatcttaccgacaagcttggaagattcttctgatgatgatattgatgatgaaatgttttatgatgatcatttggaggcttattttgaacaactggcaattccaggaatgatatatgaagacctagaaggaccagaacctccagaaaaaggttttaagttacctacaaatggtcttagacaggcaaatgaaaacggtagcttaaactgcaagtttcaatcagaaaataacagctctctgatttccctcgactcacactcttctgaaacaactcacaaagagtctgaggaaagccaagttatttgtctacctgggactagtaattctataggtactggagatagtagaaggtacacagatggtatgttaccattttcctctggtacttggggaactgagaaagaaatagaaaatttgaagggtattgttccagatcttaacagtgaatgtgcaagtaaagatgttctggtgaagaccctcagggctattgatgtgaaacttaactctgataattttcatgatgcaaatgccaatagaggtggttttgatctgactgaccctgtaaaacagggggcagagtgtcctcaccaaaataagacagttttgcacatggatggatgtttagacactgagactcctacggtgtccattcaagaaaatgtggatgtagcctctttgaagcccattagtgacagtggaattaatttcactgatgccatttggtcaccaacttgtgaaaggcgaacatgtgaatgtcacgagtccatcgaaaagaataaagacaaaacagatctcccacagagtgtggtctatcaaaatgaagagggtaggtgggtcacagaccttgcctattacacatcttttaatagcaaacaaaatttaaatgtgtctctaagtgatgagatgaatgaagacttcagatctggttccatcatttggctattttattagatcaccagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtagctttctatgtctttctcatttaacctaacagttgcattgtgattaggtgcttgatttcccccatctctagtgctaggttctcccttcacgcctttattaatgcacacagtcattgccatggtatctttctctcagaccccttttgttgtagtgcttgtagagtgtaaagtgaaacagttttgcattttccatcatttattatttatattttattgttatttattggtaaattcctataaatttgcttttagtgctattatttaaatcatcaaaagttctgagtttcttgtttctacttgtcagttttgttaaaggtgattgaatataagtaaccatgacttgtaaaaaaaaaaaaagaaagcagttactcttggagcttatgccttcatttggcaagggaagtctttttaactagtttatctgatgattttcttacatgagcttttgaaatacctggaaatgcagttttaatatgaacttttaagacagatgtctcttacatgatcaattacagttgctataattctagactctaaatcttctctcctggttacagtgaccatttgaacattggtgagtggagaggggggatatatggtcagcagctgttttgaaatgtcccagttttacgactgttacttgtgaatcagtattggtggatgcttccctcgtgcctcttagtggccatcgtctgcctggtaaaataagatcgcctccccctacgccgtcttggcttttcccctctacttccagtccttaggttagatgaaaagtaggtgattgaaggagaggattgagggtggaaggtgggctgtgaagactttttgggggcatcctggagtctgtgaatgaagcagtgttgtctatggaagtggggagtagaaaagaagatccccattgacagtgaggagggagggtggctggagttgtcactgcagtcgaggcggagtcagggctgtgggacctcagcggttagcctgactcttcttccccccagcccccacccactgctgtgttgtgtgtgctagagagacttacagggctgtgaaagagtgacctttgtcagtgtcctttttaagacaagtgagtgtaagggtcaatgtgcttgcttggaggtggactggggagacagccttggtgcagcaagaacattcaactcaggaagcatttgactcgttgtacttcagagaccataaatgacaaggttttgacatttttgaagagataataaatgttttaatttggcagtttgagtgattgggaaaaggaatcttaaactaggtgattctacttgattttcagtgtgaagccattaataacgaactttatggctcttttttgaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcgctgtttcacgttttccaaggaatccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctactccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaatgtggtatatccagaa

SEQ ID NO: 116501 - DNA, 7960 bp, Homo sapiens
  Payload ID: 2729
  Gene Symbol: CEP192
  Gene Name: centrosomal protein 192kDa
  Uniprot ID: Q8TEP8
  ENST ID: ENST00000506447
  CDS Start-End: 81-7694
agtgccctgggacacctcttcagtccgtggactttcccgctgcacactgccctccgaagtcggggacgcgggctcgtgagatggaagattttcgaggtatagcagaagaatcatttccaagctttctcaccaattcattatttggtaacagtgggattttggaaaatgtcactctttcttcaaatcttggcttgcctgttgctgtttctacacttgctagggatagatccagcactgataacaggtatcctgatatccaggcatcttacttagtagaagggagattttcagttccatccgggtcatctcccggaagccagagtgatgctgaaccaagagagaggttacagcttagcttccaggatgatgattctatctctaggaaaaagagctatgtggaaagtcaacgtttgtcaaatgctctcagcaaacagtcagctttacaaatggagacagcaggaccagaagaggagccagccggagctacagaatccttgcagggccaagatctcttcaacagggcttcaccactggaacaagcacaagactcacctattgattttcatttacagtcatggatgaataataaggaacccaagattgttgtgcttgatgctggaaaacattttgaagacaagactctaaagagtgacctaagccacactagcttattagaaaatgagaaacttatcttaccgacaagcttggaagattcttctgatgatgatattgatgatgaaatgttttatgatgatcatttggaggcttattttgaacaactggcaattccaggaatgatatatgaagacctagaaggaccagaacctccagaaaaaggttttaagttacctacaaatggtcttagacaggcaaatgaaaacggtagcttaaactgcaagtttcaatcagaaaataacagctctctgatttccctcgactcacactcttctgaaacaactcacaaagagtctgaggaaagccaagttatttgtctacctgggactagtaattctataggtactggagatagtagaaggtacacagatggtatgttaccattttcctctggtacttggggaactgagaaagaaatagaaaatttgaagggtattgttccagatcttaacagtgaatgtgcaagtaaagatgttctggtgaagaccctcagggctattgatgtgaaacttaactctgataattttcatgatgcaaatgccaatagaggtggttttgatctgactgaccctgtaaaacagggggcagagtgtcctcaccaaaataagacagttttgcacatggatggatgtttagacactgagactcctacggtgtccattcaagaaaatgtggatgtagcctctttgaagcccattagtgacagtggaattaatttcactgatgccatttggtcaccaacttgtgaaaggcgaacatgtgaatgtcacgagtccatcgaaaagaataaagacaaaacagatctcccacagagtgtggtctatcaaaatgaagagggtaggtgggtcacagaccttgcctattacacatcttttaatagcaaacaaaatttaaatgtgtctctaagtgatgagatgaatgaagacttcagatctggttctgaagcatttgatttgattgcacaagatgaagaagaatttaataaagagcatcaatttatacaggaagaaaacatagatgctcataatacttcggttgcactgggcgatacgtcctggggagctacaattaattacagtctgttgaggaaatcacgtagcacatcagatttggataaagatgatgccagttatttacgtctgtctttaggagagttctttgctcaaagatctgaagctcttggttgccttggtggtggtaacaatgtgaaaagaccatcatttggctattttattagatcaccagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcgctgtttcacgttttccaaggaatccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctactccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaa

SEQ ID NO: 116502 - DNA, 3793 bp, Homo sapiens
  Payload ID: 2729
  Gene Symbol: CEP192
  Gene Name: centrosomal protein 192kDa
  ENST ID: ENST00000589596
  CDS Start-End: 81-3793
agtgccctgggacacctcttcagtccgtggactttcccgctgcacactgccctccgaagtcggggacgcgggctcgtgagatggaagattttcgaggtatagcagaagaatcatttccaagctttctcaccaattcattatttggtaacagtgggattttggaaaatgtcactctttcttcaaatcttggcttgcctgttgctgtttctacacttgctagggatagatccagcactgataacaggtatcctgatatccaggcatcttacttagtagaagggagattttcagttccatccgggtcatctcccggaagccagagtgatgctgaaccaagagagaggttacagcttagcttccaggatgatgattctatctctaggaaaaagagctatgtggaaagtcaacgtttgtcaaatgctctcagcaaacagtcagctttacaaatggagacagcaggaccagaagaggagccagccggagctacagaatccttgcagggccaagatctcttcaacagggcttcaccactggaacaagcacaagactcacctattgattttcatttacagtcatggatgaataataaggaacccaagattgttgtgcttgatgctggaaaacattttgaagacaagactctaaagagtgacctaagccacactagcttattagaaaatgagaaacttatcttaccgacaagcttggaagattcttctgatgatgatattgatgatgaaatgttttatgatgatcatttggaggcttattttgaacaactggcaattccaggaatgatatatgaagacctagaaggaccagaacctccagaaaaaggttttaagttacctacaaatggtcttagacaggcaaatgaaaacggtagcttaaactgcaagtttcaatcagaaaataacagctctctgatttccctcgactcacactcttctgaaacaactcacaaagagtctgaggaaagccaagttatttgtctacctgggactagtaattctataggtactggagatagtagaaggtacacagatggagagttctttgctcaaagatctgaagctcttggttgccttggtggtggtaacaatgtgaaaagaccatcatttggctattttattagatcaccagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggt

SEQ ID NO: 116503 - DNA, 6455 bp, Homo sapiens
  Payload ID: 2729
  Gene Symbol: CEP192
  Gene Name: centrosomal protein 192kDa
  ENST ID: ENST00000511820
  CDS Start-End: 1-6230
agggggcagagtgtcctcaccaaaataagacagttttgcacatggatggatgtttagacactgagactcctacggtgtccattcaagaaaatgtggatgtagcctctttgaagcccattagtgacagtggaattaatttcactgatgccatttggtcaccaacttgtgaaaggcgaacatgtgaatgtcacgagtccatcgaaaagaataaagacaaaacagatctcccacagagtgtggtctatcaaaatgaagagggtaggtgggtcacagaccttgcctattacacatcttttaatagcaaacaaaatttaaatgtgtctctaagtgatgagatgaatgaagacttcagatctggttctgaagcatttgatttgattgcacaagatgaagaagaatttaataaagagcatcaatttatacagccatcatttggctattttattagatcaccagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcgctgtttcacgttttccaaggaatccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctactccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgc

SEQ ID NO: 116504 - DNA, 3284 bp, Homo sapiens
  Payload ID: 2729
  Gene Symbol: CEP192
  Gene Name: centrosomal protein 192kDa
  ENST ID: ENST00000589993
  CDS Start-End: 1-2702
ctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcgctgtttcacgttttccaaggaatccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctactccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaacaggcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaa

SEQ ID NO: 116505 - DNA, 573 bp, Homo sapiens
  Payload ID: 2729
  Gene Symbol: CEP192
  Gene Name: centrosomal protein 192kDa
  ENST ID: ENST00000508150
  CDS Start-End: 1-144
aacactggctcccgagcagcttttgttaaagcagtaggttttaaggattctcagaaaaaagttttgctggatcctaaagtattgaggatttttccagataaatttgtactcaaggaaagaacacaagaaggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtga

SEQ ID NO: 116506 - DNA, 491 bp, Homo sapiens
  Payload ID: 2729
  Gene Symbol: CEP192
  Gene Name: centrosomal protein 192kDa
  ENST ID: ENST00000585938
  CDS Start-End: 1-220
tcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaagtgaccatttgaacattggtgagtggagaggggggatatatggtcagcagctgttttgaaatgtcccagttttacgactgttacttgtgaatcagtattggtggatgcttccctcgtgcctcttagtggccatcgtctgcctggtggatctttcaacatatcgttgtttagttttcaagaataaagccatcataagacctcatgccacagaagagataaaagtgctttttataccatccagtcctggggttttcagatgcacattcagtgttgct

SEQ ID NO: 116507 - DNA, 706 bp, Homo sapiens
  Payload ID: 2729
  Gene Symbol: CEP192
  Gene Name: centrosomal protein 192kDa
  ENST ID: ENST00000507064
  CDS Start-End: 66-278
ctcttcagtccgtggactttcccgctgcacactgccctccgaagtcggggacgcgggctcgtgagatggaagattttcgaggtatagcagaagaatcatttccaagctttctcaccaattcattatttggtaacagtgggattttggaaaatgtcactctttcttcaaatcttggcttgcctgttgctgtttctacacttgctagggatagatccagcactgataacagaatatggcaacacagattctcaaaagacatctatgaattacatttctagctacacaaggagactactgaactgtctcttgatatctcatgagtttctggtccatcttaggttaggtgtctgttccaaatacagtcacctgtgactagagttttgggtcattggatctatttagaggtatcctgatatccaggcatcttacttagtagaagggagattttcagttccatccgggtcatctcccggaagccagagtgatgctgaaccaagagagaggttacagcttagcttccaggatgatgattctatctctaggaaaaagagctatgtggaaagtcaacgtttgtcaaatgctctcagcaaacagtcagctttacaaatggagacagcaggaccagaagaggagccagccggagctacagaatccttgcagggccaagatctcttcaacagggcttcaccactggaacaagcacaag

SEQ ID NO: 116508 - DNA, 1172 bp, Homo sapiens
  Payload ID: 2730
  Gene Symbol: CEP19
  Gene Name: centrosomal protein 19kDa
  ENST ID: ENST00000399942
  CDS Start-End: 296-682
gtcgctgtggaaaccgctaggccagcgctcgccgggacctggaatccctgtacgccgaggtgggagccggtggaccggtcccccagccggcccccacctccgcttcccggtgtttgagggttcgggcctcccgccggggagttcacccctcgggctcgtcagtagggctgtggctgtcgcctcttcctgcagcgccaggctccgcccggtctcacagtcggcttaggggctttgcgtgcactgcggttgggtggaaaaacccactcctggttgtttagacgttggcctgcagacgatgtcatttctgtattcctctaaggattgcaccagagctgctgaacaattaaagaataatccgcgacacaagagttacctagaacaagtatccctgaggcagctagagaagctattcagttttttacgaggttacttgtcggggcagagtctggcagaaacaatggaacaaattcaacgggaaacaaccattgatcctgaggaagacctgaacaaactagatgacaaggagcttgccaaaagaaagagcatcatggatgaactttttgagaaaaatcagaagaagaaggatgatccaaattttgtttatgacattgaggttgaatttccacaggacgatcaactgcagtcctgtggctgggacacagagtcagctgatgagttctgataccaaacactcaaaacatgcattgggctagcagaatatccatgtttattaccagactggttctggaagaagctgtaaagaatactaaatatgttgggttataggggattgaccatgttacttttcaaaaccaggacatttaaagcatctactatgtaggtgcatgaggagtatgggaaaaacagaataaaggaatctgcctttaaggagcttacaatcatgccgggtgcggtggctcacgcctgtaatcccagcactttgggaggctgaggcgggtggatcacctaaggtcaggagttcgagaccagcctagccaacatggtgaaacctcgcctctactaaaaatacaaaaattagccaggcgtggtggcgggtgcctgtaatcccggctactcaggaggctgaggcaggagattcgcttgaacctgggaggctgaggttgcagtgagccgagatcgcgccattgtactccagcctgggcgatgagcaa

SEQ ID NO: 116509 - DNA, 2201 bp, Homo sapiens
  Payload ID: 2730
  Gene Symbol: CEP19
  Gene Name: centrosomal protein 19kDa
  Uniprot ID: Q96LK0
  ENST ID: ENST00000409690
  CDS Start-End: 424-927
gggcgggcgaggagctgcgcacgcgcggggacgcgcgcccggcctgtcgctgtggaaaccgctaggccagcgctcgccgggacctggaatccctgtacgccgaggtgggagccggtggaccggtcccccagccggcccccacctccgcttcccggtgtttgagggttcgggcctcccgccggggagttcacccctcgggctcgtcagtagggctgtggctgtcgcctcttcctgcagcgccaggctccgcccggtctcacagtcggcttaggggctttgcgtgcactgcggttgggtggaaaaacccactcctggttgtttagacgttggcctgcagacgatgtcatttctgtattcctctaaggcaggaagtcattatgcaacttacacatattcatcagatttcctctgacttacccggacatgtacatgggaatgatgtgcactgccaagaaatgtgggattaggtttcagcctccagctattatcttaatctatgagagtgaaatcaaggggaaaattcgccagcgcattatgccagttcgaaacttttcaaagttttcagattgcaccagagctgctgaacaattaaagaataatccgcgacacaagagttacctagaacaagtatccctgaggcagctagagaagctattcagttttttacgaggttacttgtcggggcagagtctggcagaaacaatggaacaaattcaacgggaaacaaccattgatcctgaggaagacctgaacaaactagatgacaaggagcttgccaaaagaaagagcatcatggatgaactttttgagaaaaatcagaagaagaaggatgatccaaattttgtttatgacattgaggttgaatttccacaggacgatcaactgcagtcctgtggctgggacacagagtcagctgatgagttctgataccaaacactcaaaacatgcattgggctagcagaatatccatgtttattaccagactggttctggaagaagctgtaaagaatactaaatatgttgggttataggggattgaccatgttacttttcaaaaccaggacatttaaagcatctactatgtaggtgcatgaggagtatgggaaaaacagaataaaggaatctgcctttaaggagcttacaatcatgccgggtgcggtggctcacgcctgtaatcccagcactttgggaggctgaggcgggtggatcacctaaggtcaggagttcgagaccagcctagccaacatggtgaaacctcgcctctactaaaaatacaaaaattagccaggcgtggtggcgggtgcctgtaatcccggctactcaggaggctgaggcaggagattcgcttgaacctgggaggctgaggttgcagtgagccgagatcgcgccattgtactccagcctgggcgatgagcaaaactccatctcaaaaaaaaaaaaaaaaaaaagcttacaatctgactggaagatgtcaaaacctgtgaaaagctaattagcagtattaagcaacacaaacattagtgccaaatgcatgataaaggctaaagaaggccagagcatatattactgtagagtagaatagtaagggaagactttgtcctttagtaaagagataggaggtggcctggcccttgaaatagtagtgtttaggtagatgcttgtgtaggattcctgataagagcaactgaaaagaaggagaggggaagtagtaaagggacaagaaacaattttttttttgaggaaccataagcaaattatagtttgacaagacaagattgggggacatatatggttaccagggaattacctcttatgtgttatatctttatattatttatctctggaaaagagtaccctgcaaaattccctacagctgcaagcagatgtcacttgatggacagagggggaattctgcccctccggtatcgggaaatacatactaaagacattgcgaaacgctgaacctcttcccataaataaaaggtttgtttgtaaaatgggaaatccacccataataaatgaacaataggcactgccagtttaggcctgttcatgaatggatctgcaagacagcatcttcgtttaacaacattatctgtgatttgatacatttatccttattacaatattgtttagttggtagaaattctatgttttctacaaggaaattgatgtttattaaataaaactgaaaataatta

SEQ ID NO: 116510 - DNA, 1419 bp, Homo sapiens
  Payload ID: 2731
  Gene Symbol: CEP250
  Gene Name: centrosomal protein 250kDa
  ENST ID: ENST00000397524
  CDS Start-End: 326-1345
gttactttcccggcccctcgttgacaccgttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggtacatgatcctttgctctggaaaggagttgggcgtgggcttgtaggttccttgtgctttatggacagatagtgcaggataccagttacatattccatgatgaaatcctctaaagctaaaaaataaattttggctgaatctgaaaa

SEQ ID NO: 116511 - DNA, 15703 bp, Homo sapiens
  Payload ID: 2731
  Gene Symbol: CEP250
  Gene Name: centrosomal protein 250kDa
  Uniprot ID: Q9BV73
  ENST ID: ENST00000397527
  CDS Start-End: 721-8049
cgttcgggcagcggcctcttgttacccgggaggaacccgaggcccagagaggggctgggacgcgtcgttagggcccggggcccgcttgcctcagcttcttgctgccgccagcacgctaagctccagtcggcgccgaaggagagcttcccgaccctcgtgtccagtagccgcaatcccaggctgggagggtgaggcgccgcgctctgccgcccccccgcccctcgctccctgtgtcctggcggatttgcacgtaatctatccgaaagcccagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacaccgttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctctcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatctaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggagcgagaacggaggaagctgaagagggaggccatgcgtgcggcccaggcagggtccctagagatcagcaaggccacggcttcttcacccacacagcaggatgggagaggacagaagaactcagatgccaagtgtgtggctgaactgcagaaagaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgggatctttgcattcattttctgctgctgtctccacttgtgcagctgggtggcagcaccacatcaagggagtttatctgggaagaacttgccaaagattcctgttgaggtagcatgcatttattgtacaccatgcactgtgatagggaagggttacagagaacacacaagacaaagcccctgtccacagacagcctacagtccagttgatgagaacaggctaacactcatttatgagtcagaggcaattctgtgtactgactagaagaactgtagaaattccaggggctgaggaagggaggcacgaactggcccttgaaagatggagtggggttggaggtgttgccaagcacacagtgagaagactggtctgactgtggcagggggttggggctgagcttgggtgggttgagcggggagattttggagggttaaaagaagttctggggcctcaaaaacacagcgttgacctttagctaaagtcagagtctctgagttcagaagctccacatggcctcattcctcttctactctgggtgaatgtccttgagatgtcgcttcctgggcatatcagctggaactgatctggtcgcctgtagtccaaccatgtgtcaagccaatcagaaggatggactatggcggaacttctcacccatggactggtcctagtggaggctggacagaacccagctcacaggcttaagacctattgctggcaacctcctcaaagcctaaaaattgtttaatttttttaagagacagggttttgtcctgtcttccaagctggagtgcagtggcacaatcacatcttactgcagcctgaaactcctgggctcaagtgatcctcccacctcaacctctcaaagtgctgggattaccggtgtgagccaccatgcccaaccagaacagttttccttaaagaagcaggccattaccttcctctggcactcccaccataatctggaattcctctttactaagcctggggatggaactgagacctagccaagaatctgggaggggtaagagcagcacccactcacccagacctcctaatttggggctcagccccattatgtctcattgcaccacacagagtggaaatggggctgttcacagcgactagagctttgttccagaaacctacacatgcagctcagcaacagatgcttagtgaaaacttctgaaaccccagaaacagatctggggccccagaaatgctgtcctggtccctatttccagtcagattccctgtagcttaaaatccttacctggcttttaggccatttatttctttttcctttttttttttttgagacagagttttgctcttgttgcccaggctggagtgcagtgacgtaatctcggctcaccagtggcaacatccacctcctgggttcaagcaattctcctgcctcggcctcctgtgtatctgggattatagacacgtgccaccatgcccggctaattttgtatttttagtagagacagggtttctccatgttgatcaggctggtctcgaactcccgacctcaggtgatccacccacctcggcctcccaaaatgttgggattacgggcatgagccaccgcgcccggccctttaggccatttttatgctaggagttgtcagagacaagacttctcttggttgttcacttgttacatcctccagccctggttctcaggctcgggctgacagagggtccctgttttttaccttagagtttcttctcagcatcattttctgtaggtcatgagccagggccttaggccccacataccttctgggcctcagagaggttccagcagctgaaagacatcttagaggctgccaagcagggtctttattcaggactagactaatctgtatttgctcttctctttccatccaaccctcaagagccccccagctccattatagacctcggcctagggtctcccctccccaccagatattcagagcagggctggccttcagttcaagtgtagactgtgctcttgccctcacactcgagcttgtggatgatcttccactccggctttctaaagtacactttccttgcccagtagcaggattgcctctgtggagtgtcccaccaataatggtgacaactgctgttttcatcagctccagacccaaagagacctgaagtggggaagtgtgaaggaaggaatatgtgtcatccaggggggacccaactttgcctaagggcatgaggccggagcctcctttcctgaccttgtcacatgtggcagggtataaccagaatggtgaatccagcagacgggaggagtccctggcagtccagccagttctcgtggatgtacttgaggaaggtgcaattggccaccagaacatgcaggagtagaggttagagctcagccacagagattatcttcttgcagaaaacttttttcccccttcctaatcttgtctgctttgatagaagctggtactggctggaaaggcctgaaagcaggaggggacaagagtcgtcagaggctgggcaatgttcttgtttccggggagtgctgaggtccggcgggtgctgcccctgttctctcaaggatcccacgtgctttgtgtgttagagcagtgaccatcacctcccaacccaaggacctttgctgctctgcttcccacatgggactgccagcaccctgaaggcagaaaaactgaatgtacccgttaaaggaggagaagctggtggtgtatgttgagataaggagggtggggagtgtacagttacaggctgcacagggagggcaagatcaatgttgacaccaaagtgccaaaggctgtctgcgccaggtctggggcccccactggtcataccgcctgataaaaccattgcagtccacactaggtctggaggcttcgacacccacagcatgtgggtgttctcatgcaggccatgagtattcggggtgctttaagtgcaggggagttctgttgtccacgttattcttaaagcccagaataggccctgttttattctacagagataggaaggcactggggctcacagagtggtgctgcttcccaccctcacccttctgcccccacctgagcacagtgtggtgctcagtgatggttatcctatattccaaatacgcatggcccaggactggcagagtcggagctcggggtctagctgtgacctggggatcggttggagtagcttcttgaccagccggaattgggttaggtgtcctagcattggtgcctatggagaagaacacagactgtttatcactcacccctggttccagtaccaaggaaaggctggagccattgcaactggaggcccagcggaggaagggatcaagaagaggatgcagcccagagcccaggaccgagcatccaccggcctctggagatggcgtggtctccagttgcatcggggcttcagggcccatctgaagtgctgatcaaaccaggcagacacaccatgctggtgaaggcaggctttgtagatgcggggctgaattgagcagccacagaacctctgcagctctggggccagtggcagaacttctagaagtacctgtggggtgggaaaccccagccacaaaagcagtgagctgacttccaggcctgaggctttgcctgcaggcctcatctcagcccatgggacagattcctggtttttttagtttggccttggggtagatgataccttcagctgtccaccctgcaatacctcacctcctgccttctgacccagtactctgcagagcgggggaatggggccaggggacaggggcagggaagaggaagaagcaagagctgccagtgtgctccaaaccaagagagccctccacatgattctgggcacagctgaggaggagtgcaagctcaactctgctcaccacacttaagaagcaggcaagggaggatgaagggcaaaaacatggggtcctgaggcccttttactccctctaccctgctggaggtgaggatgagaggtgagacttcgttggactgtgctcctggccagttgatctcacccaactcattacatcagtagcctggtcacagggtggacactctgacctcttcttagcctttcattggcaatactaccagctctatatatgcccttatagggcctgaaccttggctcaggtggatgggcttggaggtaaaataattgaatgggtcaggggtaggaggagagatgagtctctgccaaggctgtgtgatgtgtcatctgagagagtgggtaacccctattcccagcacatggccatttatttagagccagggagggggacgagaattcatattcaaatgtgattctttcttaattactaccagttgttcaggtgagggaatcagggaaggccagattaataatccacacattgcccttgcacctcctgtcttggtttcctatcaaaacctctcccgtatctatgaacattccagccctgcaggtcagattgctggccaggagtagtctcacattctagctgactgatggcctcggcttctgctgttgtatgtggtttgatgattcatgctggagcctttggctataactctcttccctgtataagggccatctgaagtttgtctgcctgactccattacctggtgaatgagattggctagctgctgctcctgccccagctattcagtcatttggcaaatactcatttaaacaaagctccacagggatctctgagaaggagctcacctctaggcacacagaacctggacacagatgaaagtttgcagaatgacccagttgtgcagaagagacccactggctgctctcagtgaggccagggagagtcaaacagagcatcttggacaaagagagggcttgaaggccctttcaaagtgtcaagccagttggatgcacgggttgtgtggagtccaggggtacatccagaagcaatggcaggtgttatccattcattcaggttagacctctgagcagacggcagaaacgtcagccacaggtgagcataagctcaaacccccccattgaaggctacattcttgtcccacagggcagagcacatggcaagtggcatgctgactcagacaccgggcactgagaaaagtgggaagccatggtcacagactctacattcccctctcctgttggcctccatcccttcctcaaccgtccgcagaacacctccttccagcaccttagctcctgcctccctctggacctattcagtcctcaagggtgccctgctaaaggctgggctgaaagctaagaggagaggtggcattcaatgtgtcctgtgtcctccctggggttgattaaggggtcgatgcccaatagagtccttcatcttggtgttcagcccagggtccagctgccaagggaaggcttggcaatcaagggtgatggagataagaatgaaaaggggcaccaccctgtgccaaagctggcatgttgtatatctgagagaggagctgcctattcacagtgtagggttgtcaagctggaggcagggagagaaaagcaagagctttttggttcctcttgaggatagaatctataggaaaatgtaagagggttaaaaataaatttcccatgcatccaaacttttttctttggtagactttcttgtcatctatttaaaatgaaacaagtgcatgtacgtggttaagacattttagctaggaatgatggtgcgtgcctgtagtcccagctacttgggaggctgaggcaggaggatcgcttgaacctggaaggtcaaggctgcagtgagccgagatcataccactgcactccagcctgagtgataaaagtgagaccctgtctcaaaaaaaaaaaaaaaattaaagaagttaaacagtgccgggcttgggggctcacgcctgtaatcccagcactttgggaggcccaggcaggcagattgcttgggctcaggaattcaagaccatcctaagcgaaaaaatataaaaattagctcagtgtgatgatgtgcctgtagtcccagctactcgggaggctgaggtgggaggatcacctgagcccagggaggtcaaggttgcagtgaaccatgatcatgtcactgcactcactccagcctgggcaacagagcaagactgtctcaaaaaaaaaaaaaaaggaaattaaataaaaagaagatagcagtttcccacctcattcttctcaaactcctcttcagaggcagcgggttttgttttttttttaactatgtttttctactggctcactttattcctctaaaatagtaacttgtctatgtggtgccataacgggtccagtatctggacacgaggccgcactacctacacctttggggattctcggatcctgactctgagctacctcattcctagacacctggtgcaccacaatgtgtcagggatgtcggtttatgtgggatatttgcattttgttaggttgtgtgtggtagttgagcagccaagggggtagcatgcggtggatatttgttttagatacacagtaactggaaactcatttactgaggctatttggttaccctgaactactgtttctaccaaaaaggcaggataaatgctccctcaacacacacctttaattaccaattttcagagtaaggggttgaggtaatagccaccgccagttttccctttctctttgagtatcattatgagctcaaagttttttatatattcactatgattcaatcatgacagttgctatttttgatgctcaaattgccgcaaatctaatgtccaagtgttcttgtacttgtctaggcctagaatcttttagtgaagaaaaagtatttagaagacaaaaatcaggctgagtgcagtggctcacgcctgtaatcctagcacttgtgggaggctgaggcaggcggattgcctgagctcaggagttggagaccagcctgggcaacatggtgaaaccccgtctctactaaaatacaaaaaattagccgggggtggcggtgtgcaccttgtagtcccagctactcaggaggctgaggcaggagaattgcttgaacccaggaggcagaggttgcagtgagctgagatcgcgtcactgcactccagcctgggtggcagagcaagactccgtctcaaaaaaaaaaaaaatacgaaaaacaaaaaacataatctggattgcagggctgatcgttgctaatggagtgttatggctgttcagatgacagagggagaaaatgtactttgtaaactgttagttcaatgaggttatgattgcacaacaatgtgaacatacttaatgccactgaactttattgccattgataacttttaaatggtaaattttgtgtattattttgtcacaataaaaagtttgaaaatcga

SEQ ID NO: 116512 - DNA, 918 bp, Homo sapiens
  Payload ID: 2731
  Gene Symbol: CEP250
  Gene Name: centrosomal protein 250kDa
  ENST ID: ENST00000425525
  CDS Start-End: 1-417
atcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccggagaaatctaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacaga

SEQ ID NO: 116513 - DNA, 2648 bp, Homo sapiens
  Payload ID: 2731
  Gene Symbol: CEP250
  Gene Name: centrosomal protein 250kDa
  ENST ID: ENST00000422671
  CDS Start-End: 1-2634
ctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccagg

SEQ ID NO: 116514 - DNA, 868 bp, Homo sapiens
  Payload ID: 2731
  Gene Symbol: CEP250
  Gene Name: centrosomal protein 250kDa
  ENST ID: ENST00000446710
  CDS Start-End: 377-868
cgcagggccttagcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggag

SEQ ID NO: 116515 - DNA, 629 bp, Homo sapiens
  Payload ID: 2731
  Gene Symbol: CEP250
  Gene Name: centrosomal protein 250kDa
  ENST ID: ENST00000425096
  CDS Start-End: 1-629
aggaggaacagcaggaggagctgcacctggctgtccgggagagggagcgtctggttgctgggaagatgagagcaatgttttggaaaacgccagcatagaacctggcatatgtcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaa

SEQ ID NO: 116516 - DNA, 2156 bp, Homo sapiens
  Payload ID: 2731
  Gene Symbol: CEP250
  Gene Name: centrosomal protein 250kDa
  ENST ID: ENST00000425934
  CDS Start-End: 104-2156
ttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctgacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatcc

SEQ ID NO: 116517 - DNA, 702 bp, Homo sapiens
  Payload ID: 2731
  Gene Symbol: CEP250
  Gene Name: centrosomal protein 250kDa
  ENST ID: ENST00000420564
  CDS Start-End: 361-702
agcagcggctgccgcagctcaatcgcggagcaactagccgggcgtctgcgggagccgagcgtggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagca

SEQ ID NO: 116518 - DNA, 2295 bp, Homo sapiens
  Payload ID: 2731
  Gene Symbol: CEP250
  Gene Name: centrosomal protein 250kDa
  ENST ID: ENST00000461386
  CDS Start-End: 382-1998
cagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacaccgtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtctgcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaag

SEQ ID NO: 116519 - DNA, 607 bp, Homo sapiens
  Payload ID: 2731
  Gene Symbol: CEP250
  Gene Name: centrosomal protein 250kDa
  ENST ID: ENST00000621352
  CDS Start-End: 1-105
gatgggagaggacagaagaactcagatgccaagtgtgtggctgaactgcagaaagagggcagagcacatggcaagtggcatgctgactcagacaccgggcactgagaaaagtgggaagccatggtcacagactctacattcccctctcctgttggcctccatcccttcctcaaccgtccgcagaacacctccttccagcaccttagctcctgcctccctctggacctattcagtcctcaagggtgccctgctaaaggctgggctgaaagctaagaggagaggtggcattcaatgtgtcctgtgtcctccctggggttgattaaggggtcgatgcccaatagagtccttcatcttggtgttcagcccagggtccagctgccaagggaaggcttggcaatcaagggtgatggagataagaatgaaaaggggcaccaccctgtgccaaagctggcatgttgtatatctgagagaggagctgcctattcacagtgtagggttgtcaagctggaggcagggagagaaaagcaagagctttttggttcctcttgaggatagaatctataggaaaatgtaagagggttaaaaataaatttcccatgcatccaaa

SEQ ID NO: 116520 - DNA, 7616 bp, Homo sapiens
  Payload ID: 2732
  Gene Symbol: CEP290
  Gene Name: centrosomal protein 290kDa
  ENST ID: ENST00000309041
  CDS Start-End: 1-7446
atgccacctaatataaactggaaagaaataatgaaagttgacccagatgacctgccccgtcaagaagaactggcagataatttattgatttccttatccaaggtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagaggcaagtattgaaagtctagaggaagaacgacttgatctgaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaattaaaagaattagttgaagaaaataagcaacttgaagaaggtatgaaagaaatattgcaagcaattaaggaaatgcagaaagatcctgatgttaaaggaggagaaacatctctaattatccctagccttgaaagactagttaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcaaatgttgtttttaaaggaattgacttacctgatgggatagcaccatctagtgccagtatcattaattctcagaatgaatatttaatacatttgttacaggaactagaaaataaagaaaaaaagttaaagaatttagaagattctcttgaagattacaacagaaaatttgctgtaattcgtcatcaacaaagtttgttgtataaagaatacctaagtgaaaaggagacctggaaaacagaatctaaaacaataaaagaggaaaagagaaaacttgaggatcaagtccaacaagatgctataaaagtaaaagaatataataatttgctcaatgctcttcagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagagggtctggtagaagtggaaagacaatcccagaactggaaaaaaccattggtttaatgaaaaaagtagttgaaaaagtccagagagaaaatgaacagttgaaaaaagcatcaggaatattgactagtgaaaaaatggctaatattgagcaggaaaatgaaaaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaacttatt

SEQ ID NO: 116521 - DNA, 2421 bp, Homo sapiens
  Payload ID: 2732
  Gene Symbol: CEP290
  Gene Name: centrosomal protein 290kDa
  ENST ID: ENST00000397838
  CDS Start-End: 1-2421
atgccacctaatataaactggaaagaaataatgaaagttgacccagatgacctgccccgtcaagaagaactggcagataatttattgatttccttatccaaggtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagaggcaagtattgaaagtctagaggaagaacgacttgatctgaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaattaaaagaattagttgaagaaaataagcaacttgaagaaggtatgaaagaaatattgcaagcaattaaggaaatgcagaaagatcctgatgttaaaggaggagaaacatctctaattatccctagccttgaaagactagttaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcaaatgttgtttttaaaggaattgacttacctgatgggatagcaccatctagtgccagtatcattaattctcagaatgaatatttaatacatttgttacaggaactagaaaataaagaaaaagttaaagaatttagaagattctcttga

SEQ ID NO: 116522 - DNA, 5968 bp, Homo sapiens
  Payload ID: 2732
  Gene Symbol: CEP290
  Gene Name: centrosomal protein 290kDa
  Uniprot ID: O15078
  ENST ID: ENST00000547691
  CDS Start-End: 1181-5800
aagcttaatactgagcatcaagaaattctttaataaatataagtgatatttattcagacatgtaataaggaaatgttcatgtcttatttttgtgttagatttttttagaatctacttttgttagagttttataaatacagttagtgtttgagatagaaagagaaaagaattagttttcttcctcttctacctgctcatgaacttgatttttttctcccaacaattgaagagccaagaaaaagggagattcttaagagatgggaaatagaatctcatctacccctgtttcccccagaacagtgaaactgaatcttaagggtaagatagaatagtgtgtacttaacttagatggagaagaaaggctgccaaaatgagatctgaagcgctattacaaatatttccatcgttactgtacttcagaatgaattacaaccgtaagtttttttacttcctcattcataaatttgattattccttataccacttctcagctttcatcattctttattgtacttttctatgtaatgtttgcctattatacagcaacttaagagaactgtaagtttggacatttcattttggtgttgataatagaatatctttgaatagttctatagttgatgagtagaaccatgaaccaagtaacttaaagtccttgatgttatttattacagagaactataatagaagctctcccgctaatgtttccatcatgtgtacaaaaagttttcttgttattaaagctagtccgtttaacttacaataagcataaatagctaagctgtgaaagttacctgtgataatgctaattttcccatttattaaaaggcaagttgttttccgatcataagaaatttagaaaagccatccaaagataaattccgagtgatatattcctgctgtttgttatgttttctcaaattaattgagttttattttacaatgacaggagttattaaagtattttatttttattatgattaagattttcaaagtaacatttcttatatgaaagaaattatgttaatgcatgtttttcttacatgggaaatcatatattttaaaaatgattttaaaattcgttttactttaagttgtattatctttctcaaaagtggctagtgcttgaccagaaaaaaagacaccagcataactcagtgtatctttatttacataggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagagggtctggtagaagtggaaagacaatcccagaactggaaaaaaccattggtttaatgaaaaaagtagttgaaaaagtccagagagaaaatgaacagttgaaaaaagcatcaggaatattgactagtgaaaaaatggctaatattgagcaggaaaatgaaaaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaactta

SEQ ID NO: 116523 - DNA, 1285 bp, Homo sapiens
  Payload ID: 2732
  Gene Symbol: CEP290
  Gene Name: centrosomal protein 290kDa
  ENST ID: ENST00000552770
  CDS Start-End: 1-324
gtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaagtaaagcactttttttttccatgaatcttcactgttcaagttacctggctttttattattattggtaacaatatcaatttttatattgtatgttatatttgaaaaatgatgtacacttatctctaaggttttatatcactgttcattttgtcatcaccaattttaaaatataatggtacttctagtgaatatgacttgaagattaattctttatatttggaagtacatttttctcaggacatcaaacttgttacctaaaattaatgcttttgtctggaagattggtatcaagtaactaatagattttcataaagaagtgatctttctagtgccatagtttattttgggtaaaagttatatttgttcatttcaatgtatttatatgattagtagattcgcaaatgaatctttcgatatattcaataatggttaattaaatatcttgtttttggttgtaccttattttatgtgagatatatatatatatgtatagtttttgaaaagttgtgttcatgtcagcagtttataaatcacatatttaaaataacatttttaatgcatagtttttattacctcgttattccttgttataaactaataattcttgcagtgttcacttgaatttagttttaggaaaaaagttttttgcagatcaacttgtatttcctggaagaaaatttcctattttacctcagcttcctatttaatgtattatttatttatttacttaacatttatttgttttttatttcacctgaactgttagtaaacttagtaaaatttggtgcctacatgtggtaactgtcctgtcccttatactcagaaacgttttccacctttgtgtcctttaggtcattgttgtgttatattccatttattttattttgtccattgttctctcagaaattgagggtcatacattttaagaaaacaatgatatgctatttaagagaatgtatcataaattgatttgtaaggaaaagta

SEQ ID NO: 116524 - DNA, 697 bp, Homo sapiens
  Payload ID: 2732
  Gene Symbol: CEP290
  Gene Name: centrosomal protein 290kDa
  ENST ID: ENST00000550962
  CDS Start-End: 206-697
ggcggagttggggatggtgtcgcctagcagccgctgccgctttggcttgctcgggaccatttggctggacccagagtccgcgtggaaccgcgatagggatctgtcagggcccgcggccgggtccagcttggtggttgcggtagtgagaggcctccgctggttgccaggcttggtctagaggtggagcacagtgaaagaattcaagatgccacctaatataaactggaaagaaataatgaaagttgacccagatgacctgccccgtcaagaagaactggcagataatttattgatttccttatccaaggtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaaaacaaacgtctaaagaaaaagaatgaacaactttgtcaggatattattgac

SEQ ID NO: 116525 - DNA, 7948 bp, Homo sapiens
  Payload ID: 2732
  Gene Symbol: CEP290
  Gene Name: centrosomal protein 290kDa
  Uniprot ID: O15078
  ENST ID: ENST00000552810
  CDS Start-End: 345-7784
atttgaagtcctcgttccacgccttctcatcatcctgaacaccgagctctgggactccggcggagaatctaaacgtaaagcatcacccacggtcgtgaactgtaggctctcctggcatccgggatcttattctggccttggcggagttggggatggtgtcgcctagcagccgctgccgctttggcttgctcgggaccatttggctggacccagagtccgcgtggaaccgcgatagggatctgtcagggcccgcggccgggtccagcttggtggttgcggtagtgagaggcctccgctggttgccaggcttggtctagaggtggagcacagtgaaagaattcaagatgccacctaatataaactggaaagaaataatgaaagttgacccagatgacctgccccgtcaagaagaactggcagataatttattgatttccttatccaaggtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagagattgaaagtctagaggaagaacgacttgatctgaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaattaaaagaattagttgaagaaaataagcaacttgaagaaggtatgaaagaaatattgcaagcaattaaggaaatgcagaaagatcctgatgttaaaggaggagaaacatctctaattatccctagccttgaaagactagttaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcaaatgttgtttttaaaggaattgacttacctgatgggatagcaccatctagtgccagtatcattaattctcagaatgaatatttaatacatttgttacaggaactagaaaataaagaaaaaaagttaaagaatttagaagattctcttgaagattacaacagaaaatttgctgtaattcgtcatcaacaaagtttgttgtataaagaatacctaagtgaaaaggagacctggaaaacagaatctaaaacaataaaagaggaaaagagaaaacttgaggatcaagtccaacaagatgctataaaagtaaaagaatataataatttgctcaatgctcttcagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagagggtctggtagaagtggaaagacaatcccagaactggaaaaaaccattggtttaatgaaaaaagtagttgaaaaagtccagagagaaaatgaacagttgaaaaaagcatcaggaatattgactagtgaaaaaatggctaatattgagcaggaaaatgaaaaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaa

SEQ ID NO: 116526 - DNA, 2122 bp, Homo sapiens
  Payload ID: 2732
  Gene Symbol: CEP290
  Gene Name: centrosomal protein 290kDa
  ENST ID: ENST00000547926
  CDS Start-End: 1-1842
gtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagagattgaaagtctagaggaagaacgacttgatctgaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcaaatgttgtttttaaaggaattgacttacctgatgggatagcaccatctagtgccagtatcattaattctcagaatgaatatttaatacatttgttacag

SEQ ID NO: 116527 - DNA, 2741 bp, Homo sapiens
  Payload ID: 2732
  Gene Symbol: CEP290
  Gene Name: centrosomal protein 290kDa
  ENST ID: ENST00000604024
  CDS Start-End: 1-2574
gatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagagattgaaagtctagaggaagaacgacttgatctgaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaaatcatagcacaggaattcttgatcaaagaagcagagtgtagaaatgcagatatagagcttgaacatcacagaagccaggcagaacagaatgaatttctttcaagagaactaattgaaaaagaaagagatttagaaaggagtaggacagtgatagccaaatttcagaataaattaaaagaattagttgaagaaaataagcaacttgaagaaggtatgaaagaaatattgcaagcaattaaggaaatgcagaaagatcctgatgttaaaggaggagaaacatctctaattatccctagccttgaaagactagttaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcaaatgttgtttttaaaggaattgacttacctgatgggatagcaccatctagtgccagtatcattaattctcagaatgaatatttaatacatttgttacaggaactagaaaataaagaaaaaaagttaaagaatttagaagattctcttgaagattacaacagaaaatttgctgtaattcgtcatcaacaaagtttgttgtataaagaatacctaagtgaaaaggagacctggaaaacagaatctaaaacaataaaagaggaaaagagaaaacttgaggatcaagtccaacaagatgctataaaagtaaaagaatataataatttgctcaatgctcttcagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgaggtttgatattataagttttatcatacaattatagaataaagaattagttttggtagacattgtattattgttaagtggtttgtctggatctctgaaatatcttattaatatagtgcctatgttttgtgtaataaataaataaaagatttaaatctgaattgtttaaaaggaaa

SEQ ID NO: 116528 - DNA, 8057 bp, Homo sapiens
  Payload ID: 2733
  Gene Symbol: CEP295
  Gene Name: centrosomal protein 295kDa
  Uniprot ID: Q9C0D2
  ENST ID: ENST00000325212
  CDS Start-End: 163-7968
atgacggaagtgacggcggctcggcgatggctctcccgcaggcgcagaaacggctgctgggcagctgatgggcaggagcttaccaggctggcttgctctgagctgcggttactgtgtccaggccccgggttctcagaactgtcatacataaagtacacagaaatgaagagaaaagtcgtgaatactcacaagctgagattgagtcctaatgaggaagccttcattttgaaggaagattatgaaagaaggcgaaaactaagattgctacaggttcgagaacaagaaagagatatcgccttacagataagagaagacataaaacagaggagaaatcaacaatttacacgtttggcagaggagctaagggcagaatgggaagaatcacaaactcagaaaatacagaacttggaaaaactgtatttggcaagtttaagaagtatgggagagggacatcgacaggccaaagaaaatgaacctgatttggatgctttggcacagcgggcagcagaaaggaaaagaaaagcagatttgaggcataaagaagccttgaaagtacagaaaaatcaaaaagaaatattactgaaacaaaaaacctggcatataaaagctcgaaaggaagcactgcttgtggaaaaagagagatcagccaaaattacaagtctgccacctcctcctccaactctttttgagaacatcgaagtaaaaagaatttctgcagtcaaaaccaatagttctacctaccatcatcttcacacttttgtgaatagagagacagacacaaaacggccagatgctcgtttggctgctgaagaggaagctaaacgattggaagaactacaaaaacaggcagcacaagagagaatggaacggtttgaaaaggcacatgtacggggattccaagcaatgaagaagatccatttggctcaaaatcaggagaaactaatgaaagaactcaaacagctacagcaagaggacctggcacgtaggagacagactgtagcacaaatgccaccacaactagttgaacttccatacaaacgcagtgaaatgaaagaagactggcagagagaattggaatttgcctttgaagatatgtacaatgcagacaggaaggtgaaagggaatctgattctgcaccttgaaccagagcccttgcccactgtgactaatcagatccaagatgaagagctggacctttcaatggaacaagaaaatttgggtgcagctgaagaccttccagtgacagaagctgaaatatgttctagtgaaacagatgttcccttggtaatgaagacccaacagattccttcaaaagttctttttaaaaaattattaaataagatccgaagccaaaaatctctctggacaattaaatctatgtctgaggatgaaagtgaaatgattacgactgttagtgaaattgagagtaaagcaccaacggttgagtcaggaacaattgccagcaaagagagaacgttatcctctgggcaggaacaagttgttgaaagtgatacactaacaattgagtctggaccacttgctagtgaagataaaccactttcgtgtggtacaaactctggaaaagaacaagaaataaatgagactctgcctatcacaactgtagctcagagttcagttctacttcatcctcaagaagcagcagccaggattagaatgtcagcaaggcagaaacagataatggaaatagaagagcagaagcaaaagcaattggaattacttgaacaaattgaacagcagaaattaagattagaaactgactgcttcagggctcagctggaagaagaaaaaagaaaaaaaactcaaccgactggggttggcattgctccagcatcatgccctgtaatttctgatgaagatagtcataggcagatgattcgtaactatcaacatcagcttttacaacaaaacaggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaaggtcagagactcaagttgagtcctaacaaataccaacccatacaacctatacagacctccaaattagaacaagatcattttcaggtagcgagacaaaatcactttccacaaagacaggtggaaacaacagaaacattacgcgcttcagatattttaaccaatcaagctttagaatcacaagaacatctaaggcaattctctcagactgaaacacaacagagagactataaattggtccccaaagattctgagacactttcaagggctttgtcacatgacaggcagctaatatcacaggatgctagaaaaatatctgaaacatttggggcaacaacttttcaaagtttagaatcccaacaattgttctcagagaatagtgaaaatatatcttaccatttaactgaaccttcttcatttgtaccactggtacctcagcattcttttagttctctgcctgttaaagttgagtcaggaaaaattcaagaacccttttcagccatgagcaaaagtacagtttccacaagccattctataatcagccaaatgcatgataggcctttgctgccgtcagagaatatcacagcccagcaaggtaatatgaaggccctccaagaacagttagacctacagaagaaagttcttcaggcaactcaggaagctcaggaacagttgcttttgtgcaaacagaaagaagtggaacagcaaacgggcctctcggtattccttcccttggtaactccagattcatctgctttattgccttctgccaaagcagatttggggagaatccaggaatcttcaccaaccaagaataatattgcagtttcctcagaccatcatgtgatctcacaacttcaggataagcgtttgagtctttcacagcctatcctatcacagcaaaataattttaaatttctccaagagcagttgaatattcagaaggatagccttcaggctaggcgagaagcccaggaagtattgtatgtacataaacagagtgaattggatagaagagtatgttccgaacaggctgagccctctttcccatttcaggtagctcagcatacatttacttcactaccatctgctgatacaaaatctggaaaaatacaggagcaacattcatctaagagcgagaaaggacttgtttcatgccaatctgacatccccatatctcaggatgggtctttgagtttcctacagcagttcctacctctacatgatagtttgaagttgctccaagaacagttgactaaacagagggatactcttcaggctaggcatgaagctcaggtggaattacttttacatagacaaagagatttgggggacagtaagtctgggctggtgagctcttcatcctcaccagtggttgttcagcattcagttgcttcacaagcttctgctaaagctgagcctaggagaattcaggagctttatttatctgagaaggagaatgtaggtccctcctgtcatttgataatcccaacatttcaggataagtctcttagttttccacagcatagcctggcacagcaagaaaatttgacaatactccaagaacagtcacaaatacaaagggtaatacttggtgctaaagaaggaactcaggaatttgtacacacagaaagtgaattggagaaaagaatttcttctgaacagactggcacctcctcatccctttcccaggtggatgaatctgagagattccaggaatgtatatcaatcaagagtgacagtaccattcccttaagccatcctaagatcccaagatgtcaggaaagacttttgagagtttcacaacatatgctacctctacaagataatttggaggaacaccaagcatggctagacactgagaaagaagcctttcatttcagccagaaaacccaagaaaatacatcttctgaacaaactggttcatcttcattcataccccagttggtacagctttcatttacttcgttagcttcagctgagtctggcacaatcctggaacctctttttacagagagtgaaagtaaaattttttcaagccaccttcagatcccacaattgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcaggcacttcaacagcagttagatacacagaagaaagccattcgatctatacaggaagtccaagaagaattgcttttgcaaagattaagtgaattggagaaaagggtatcatctgaacaagtttgctcctcttcatttgtatcccaggtgcctgttgctgactctgaaagaacccagaagtctttcccaaccaaaagtaatgatactcttccctcaagtcatcgtgagattccaagattacaggatagacttttgagtttatcaaagcctattctgcctcagcaagataatatgacagcacaattggatgcacaaagggaagtgatgtattcttatgagaaaccccaggaagaactgtctttaaacaaacaaagaaagttgaacaaaagtgaatctgctgagcatactatcccctctttgtttctacccaaggaaacagagcattcgtttattccactaccttttgcagaagctaaacctaaaagcacttgtgaattgtattcatcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtgagcatctggagaaagatctggggagaagatcctcaaagccacctgtagcaaaagtcaaatgtggtttggacttaaaccagcatgaacttagtgctatacaagaagtagagtcaccagcaattggcagaacttctatactaggtaaaccaggtatttatgaagacagagaccccctgcgagtctcaataagccgagaacaaagtttctttgggagcccactggcccatgatccgtttagttgtcttcaactggttggccaagagaatgtctgtggtgatgactatgatgaagcagttaagctgaaggaatctgttgttgaaaatcatgcagtgttaagttatgctgtggaggaagaacatgcatatttgggtccaactgtgaagccagatgataaggctaaaacactgtcttatgaaccattatcttcagcaactgtttccactgggagccttttaagttatgaaaacacagatttgagccttacagatccagagtcattttcagagcacatggatgatagcaagcaagaatctaccaccagtaaagaagaggaaacaaatattataagttccatagttccttcaacacaagatatttatcagcggcagaactcttcagacgttcataaatctctgttgcctgcagtggatgaaactacatgtggtcacacacactttcagcaaatgatagacaagtacattaatgaagcaaatttgatacctgaaaaaacagatttgcaagaattggaacacatttttcctaatttgcatcatcagctgtttaaacccttagaaccacatccagattttgacttatcatcatcatcctctgggatttctccagacaacagagacttttaccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaactatctcaactaggagaatcagagctttttgcaagttctggatcattttcattacagagctctataccagtctgggaaacagaaactggccatggtataatggaagaaccagaacttactttaataagcaccactgataccagtattgctgaaatggattttgcaaatttaaccctagaagagaagagcgagaatgaagcaaaatgcttctttcaggtgagtgagtttctgcctcttgtatcagcaacagaagcctcagattatccagctgtatcagaactttccatagaaaaaccaaggacagcatctacagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaacaaaaggaagaaaaaacaaaacaagaagcttatgcccaaaacagagcaagggcaaaagaattccataagaaaacactagagaaacttcgagccaaaaatacatgctgactttctagaaatagtgtaaaggttttttaattgtgtatatgtagcattagacaaaattatttaaagtcaataaattgttattcgaggaa

SEQ ID NO: 116529 - DNA, 1735 bp, Homo sapiens
  Payload ID: 2733
  Gene Symbol: CEP295
  Gene Name: centrosomal protein 295kDa
  ENST ID: ENST00000530425
  CDS Start-End: 1322-1735
attgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcaggcacttcaacagcagttagatacacagaagaaagccattcgatctatacaggaagtccaagaagaattgcttttgcaaagattaagtgaattggagaaaagggtatcatctgaacaagtttgctcctcttcatttgtatcccaggtgcctgttgctgactctgaaagaacccagaagtctttcccaaccaaaagtaatgatactcttccctcaagtcatcgtgagattccaagattacaggatagacttttgagtttatcaaagcctattctgcctcagcaagataatatgacagcacaattggatgcacaaagggaagtgatgtattcttatgagaaaccccaggaagaactgtctttaaacaaacaaagaaagttgaacaaaagtgaatctgctgagcatactatcccctctttgtttctacccaaggaaacagagcattcgtttattccactaccttttgcagaagctaaacctaaaagcacttgtgaattgtattcatcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtaaaccaggtatttatgaagacagagaccccctgcgagtctcaataagccgagaacaaagtttctttgggagcccactggcccatgatccgtttagttgtcttcaactggttggccaagagaatgtctgtggtgatgactatgatgaagcagttaagctgaaggaatctgttgttgaaaatcatgcagtgttaagttatgctgtggaggaagaacatgcatatttgggtccaactgtgaagccagatgataagagtcattttcagagcacatggatg

SEQ ID NO: 116530 - DNA, 1298 bp, Homo sapiens
  Payload ID: 2733
  Gene Symbol: CEP295
  Gene Name: centrosomal protein 295kDa
  ENST ID: ENST00000529185
  CDS Start-End: 1062-1298
tgctacaacaccgttttaccacagaatatattgagggcatttagtgagaaaggggatctggaaccaattagactcactgaggcacatttataggagattaattagcaaatcttcctttgccattgcagagttagctattacggctgaggcggtattactgataaataagagcaggagctcagaaatcatacagttctggatttgagtcatagcctgaccatttcctagctgtaaaaccatgggcaagttactttttaatcttttataaaagaggaatattatagattaaatgagatagtgcacataaagcacaatgtctggcccatagtaacactgaatacagtgagcctttttccttttttaagcttatactgaagcagtggttacatatgtcctgttgatcctcattagcctcataaggctgtggaaatggaaattcgtatttgtcaaaagtttgttcatacctgtaatcgtagcactttgggaggctgaggcaggaggattgcttgagcccaggatttcaagaccagcctgggcaacactgagaccccatctctattttaaaaaaaaattttttaaatttaaaaaaattaaatttctctaaaaataaaacttaaaaagttttggtcactgagaggatccatattttggacctttgaaataatcatgataggacttaactttaaagcatctgctgatcatgggggaaaaactgaagtttttgttacactggagttacctgaaaataagcgtttatgaatatgttcttaatactccttttctagtgtttaccttaaaaataaatttatgatttttttccctcaaaaattctaacagttgaccttgactttccagaattggaacacatttttcctaatttgcatcatcagctgtttaaacccttagaaccacatccagattttgacttatcatcatcatcctctgggatttctccagacaacagagacttttaccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggatctgaacaatgttttgaacagcttcagccagaatattcttcacaggaggagagccagcatgctgatctaccaagtatttttagcattgaagcaagagattcttcccaaggcatgaaaaatcagaactatccctctgaa

SEQ ID NO: 116531 - DNA, 2294 bp, Homo sapiens
  Payload ID: 2733
  Gene Symbol: CEP295
  Gene Name: centrosomal protein 295kDa
  ENST ID: ENST00000531404
  CDS Start-End: 557-2294
tggcgcatatggtattctaaatattactggaagtaacagggatgctctgtagatccccaacaatacttttgagaagcagttgctgatatatttttccattcagtggaaacctatccgagcaaatttcatggttgcactgatctcttaacaatatgtattaccatgcttctccactaaaatatgtctgtaaggaagtacccagtacagtatgtctgtaaggaatattccattaaaaggaatatagtgtcgctgtcaattacatttttttttcttttgagatggagtcttgctctgttgccaggctggagtgcaatggtgcaatctcggctctcccgagtagctgggactacaggtgtgcgccaccacgcccagctgatttttgtatttttagtagagatggggtttcaccatgttggcgagatggtctccatctcttgacctcgtgatccacccacctcggcctcccaaagtgctggtattacaggcgtgagccatcacgcctggcctatttacatattttcattaaactcaattttcagagtcattttcagagcacatggatgatagcaagcaagaatctaccaccagtaaagaagaggaaacaaatattataagttccatagttccttcaacacaagatatttatcagcggcagaactcttcagacgttcataaatctctgttgcctgcagtggatgaaactacatgtggtcacacacactttcagcaaatgatagacaagtacattaatgaagcaaatttgatacctgaaaaaacagatttgcaagaattggaacacatttttcctaatttgcatcatcagctgtttaaacccttagaaccacatccagattttgacttatcatcatcatcctctgggatttctccagacaacagagacttttaccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaactatctcaactaggagaatcagagctttttgcaagttctggatcattttcattacagagctctataccagtctgggaaacagaaactggccatggtataatggaagaaccagaacttactttaataagcaccactgataccagtattgctgaaatggattttgcaaatttaaccctagaagagaagagcgagaatgaagcaaaatgcttctttcaggtgagtgagtttctgcctcttgtatcagcaacagaagcctcagattatccagctgtatcagaactttccatagaaaaaccaaggacagcatctacagcagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaac

SEQ ID NO: 116532 - DNA, 744 bp, Homo sapiens
  Payload ID: 2733
  Gene Symbol: CEP295
  Gene Name: centrosomal protein 295kDa
  ENST ID: ENST00000531877
  CDS Start-End: 1-744
aattgagtctggaccacttgctagtgaagataaaccactttcgtgtggtacaaactctggaaaagaacaagaaataaatgagactctgcctatcacaactgtagctcagagttcagttctacttcatcctcaagaagcagcagccaggattagaatgtcagcaaggcagaaacagataatggaaatagaagagcagaagcaaaagcaattggaattacttgaacaaattgaacagcagaaattaagattagaaactgactgcttcagggctcagctggaagaagaaaaaagaaaaaaaactcaaccgactggggtaggatgcagaaaatctcatcactacataaatcatttggttggcattgctccagcatcatgccctgtaatttctgatgaagatagtcataggcagatgattcgtaactatcaacatcagcttttacaacaaaacaggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaaggtcagagactcaagttgagtcctaacaaataccaacccatacaacctatacagacctccaaattagaacaagatcattttcaggtagcgagacaaaatcactttccacaaagacaggtgga

SEQ ID NO: 116533 - DNA, 2890 bp, Homo sapiens
  Payload ID: 2733
  Gene Symbol: CEP295
  Gene Name: centrosomal protein 295kDa
  Uniprot ID: Q9C0D2
  ENST ID: ENST00000531700
  CDS Start-End: 458-2803
ttggaattacttgaacaaattgaacagcagaaattaagattagaaactgactgcttcagggctcagctggaagaagaaaaaagaaaaaaaactcaaccgactggggtaggatgcagaaaatctcatcactacataaatcatttggttggcattgctccagcatcatgccctgtaatttctgatgaagatagtcataggcagatgattcgtaactatcaacatcagcttttacaacaaaacaggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtaaaccaggtatttatgaagacagagaccccctgcgagtctcaataagccgagaacaaagtttctttgggagcccactggcccatgatccgtttagttgtcttcaactggttggccaagagaatgtctgtggtgatgactatgatgaagcagttaagctgaaggaatctgttgttgaaaatcatgcagtgttaagttatgctgtggaggaagaacatgcatatttgggtccaactgtgaagccagatgataaggctaaaacactgtcttatgaaccattatcttcagcaactgtttccactgggagccttttaagttatgaaaacacagatttgagccttacagatccagagtcattttcagagcacatggatgatagcaagcaagaatctaccaccagtaaagaagaggaaacaaatattataagttccatagttccttcaacacaagatatttatcagcggcagaactcttcagacgttcataaatctctgttgcctgcagtggatgaaactacatgtggtcacacacactttcagcaaatgatagacaagtacattaatgaagcaaatttgatacctgaaaaaacagatttgcaagaattggaacacatttttcctaatttgcatcatcagctgtttaaacccttagaaccacatccagattttgacttatcatcatcatcctctgggatttctccagacaacagagacttttaccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaactatctcaactaggagaatcagagctttttgcaagttctggatcattttcattacagagctctataccagtctgggaaacagaaactggccatggtataatggaagaaccagaacttactttaataagcaccactgataccagtattgctgaaatggattttgcaaatttaaccctagaagagaagagcgagaatgaagcaaaatgcttctttcaggtgagtgagtttctgcctcttgtatcagcaacagaagcctcagattatccagctgtatcagaactttccatagaaaaaccaaggacagcatctacagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaacaaaaggaagaaaaaacaaaacaagaagcttatgcccaaaacagagcaagggcaaaagaattccataagaaaacactagagaaacttcgagccaaaaatacatgctgactttctagaaatagtgtaaaggttttttaattgtgtatatgtagcattagacaaaattatttaaagtcaataaattgttattcgagg

SEQ ID NO: 116534 - DNA, 392 bp, Homo sapiens
  Payload ID: 2734
  Gene Symbol: CEP350
  Gene Name: centrosomal protein 350kDa
  ENST ID: ENST00000357434
  CDS Start-End: 1-392
atgaggagcagcaaatcaaaagaggtgcctttaccaaatccaaggaactctcaaagcaaggatactgttcaagatataaccacatcgtgggatgcactttctcaaaccaaggctgctctgagacacattgaaaataaattagaagtagcccctacaagtacagctgtgtgtgattctgtcatggataccaagaagtcttctacaagtgctactcgaaaaataagtagaaaagatggtagatacctggatgattcttgggttaatgctccaatctccaaatccactaaatcacgaaaagagaaatctcgtagtcctctcagggccaccaccctggagagtaatgtgaagaaaaataatcgtgtggaatttcgtgaacctttggtttcttatag

SEQ ID NO: 116535 - DNA, 13491 bp, Homo sapiens
  Payload ID: 2734
  Gene Symbol: CEP350
  Gene Name: centrosomal protein 350kDa
  Uniprot ID: Q5VT06
  ENST ID: ENST00000367607
  CDS Start-End: 419-9772
gcccgactgctcccgccctgcctcgcgccgccgccacagccgctgccgctggcgccgctcctcctccgtgtcagttgttgggctgtaatggcgactgggccgcccctgacgaagtgactcccgggccggggagcggggccagacctgcgccagagagaactgcagggagccgcagctcggggggtggcttgccctgagggaggggaggcagcctttccgccttgtcttccttcccagcggaccggcggatccccggagccggtgcgaggagggcacccggtgcgtccccggagcggggaggccaggccgggcagccctggggccggtcggggcggcgtcactgcaccctccgccaggctccgcgggatgcaccgtggtagccgagggcggaggcgacactctcaggtaaattggcaggatgaggagcagcaaatcaaaagaggtgcctttaccaaatccaaggaactctcaaagcaaggatactgttcaagcagatataaccacatcgtgggatgcactttctcaaaccaaggctgctctgagacacattgaaaataaattagaagtagcccctacaagtacagctgtgtgtgattctgtcatggataccaagaagtcttctacaagtgctactcgaaaaataagtagaaaagatggtagatacctggatgattcttgggttaatgctccaatctccaaatccactaaatcacgaaaagagaaatctcgtagtcctctcagggccaccaccctggagagtaatgtgaagaaaaataatcgtgtggaatttcgtgaacctttggtttcttatagggaaatccatggtgcaccttccaatttcagttccagccatctggaatcaaagcacgtatactgtgtagatgttaatgaagaaaagactgagagcggtaactggatgataggcagtcgagaagaacggaatatacggagctgtgattttgagagctcccaatcatctgtcatcaatgatacagttgttaggtttttaaatgatcgaccagcaattgatgcattgcaaaattctgaatgtttgattaggatgggagcttctatgagaactgaggaagaaatgcctaacagaacaaaaggaagtgagaataatttgaagctttctgtgaataacatggcccatgatactgatccaaaagcgttacgactaactgactcttctccatcctctactagtacttctaattcccaaagattagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggccaaaccagggtatcagccatctggagaatctgacaaagaaaacaaagtacaggaacgtcccccaagtgcatcttccagtagtgacatgtctctctcagaacctccacagcctcttgcaagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaaagattcatcttgtaatagttaaacctccatcttgaagcttctatggttcatagtctttgcacaggaacctgtggttttaacaaaccaatacacatattgaagaagtcattttaattcagtgaaacgaagatgggcttttccagatcacctgcaatagcagcagtgggataaaatgatttaaaaacactgtacaatttaactctgcctctcttgcagcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaatttca

SEQ ID NO: 116536 - DNA, 2724 bp, Homo sapiens
  Payload ID: 2734
  Gene Symbol: CEP350
  Gene Name: centrosomal protein 350kDa
  ENST ID: ENST00000417046
  CDS Start-End: 1-1746
aataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccag

SEQ ID NO: 116537 - DNA, 992 bp, Homo sapiens
  Payload ID: 2734
  Gene Symbol: CEP350
  Gene Name: centrosomal protein 350kDa
  ENST ID: ENST00000418229
  CDS Start-End: 1-992
ggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagagacggggtcttgctctgtcacccaggctggtctcgaactcctggcctcaagggatcctcccaccttggcatcccaaaatgctggaattacagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaag

SEQ ID NO: 116538 - DNA, 408 bp, Homo sapiens
  Payload ID: 2734
  Gene Symbol: CEP350
  Gene Name: centrosomal protein 350kDa
  ENST ID: ENST00000437245
  CDS Start-End: 1-333
tcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagaggttagacataggaagaagggggtttagtatcaaggctaatgtgtatgtgacgtctaaaatgtttttaatgttgttaataaagtaatggattaggattcttca

SEQ ID NO: 116539 - DNA, 6096 bp, Homo sapiens
  Payload ID: 2734
  Gene Symbol: CEP350
  Gene Name: centrosomal protein 350kDa
  ENST ID: ENST00000429851
  CDS Start-End: 1-3877
ctttacgtctcatcactgggcctctctcagtgtctgttttcccaaccttcatcccaaattccagctgtatatctacaaccagttggtcaggtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaaagattcatcttgtaatagttaaacctccatcttgaagcttctatggttcatagtctttgcacaggaacctgtggttttaacaaaccaatacacatattgaagaagtcattttaattcagtgaaacgaagatgggcttttccagatcacctgcaatagcagcagtgggataaaatgatttaaaaacactgtacaatttaactctgcctctcttgcagcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccag

SEQ ID NO: 116540 - DNA, 434 bp, Homo sapiens
  Payload ID: 2734
  Gene Symbol: CEP350
  Gene Name: centrosomal protein 350kDa
  ENST ID: ENST00000490047
  CDS Start-End: 1-174
gtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgaggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaag

SEQ ID NO: 116541 - DNA, 1059 bp, Homo sapiens
  Payload ID: 2734
  Gene Symbol: CEP350
  Gene Name: centrosomal protein 350kDa
  ENST ID: ENST00000491495
  CDS Start-End: 332-1059
acagccgctgccgctggcgccgctcctcctccgtgtcagttgttgggctgtaatggcgactgggccgcccctgacgaagtgactcccgggccggggagcggggccagacctgcgccagagagaactgcagggagccgcagctcggggggtggcttgccctgagggaggggaggcagcctttccgccttgtcttccttcccagcggaccggcggatccccggagccggtgcgaggagggcacccggtgcgtccccggagcggggaggccaggccgggcagccctggggccggtcggggcggcgtcactgcaccctccgccaggctccgcgggatgcaccgtggtagccgagggcggaggcgacactctcaggatgaggagcagcaaatcaaaagaggtgcctttaccaaatccaaggaactctcaaagcaaggatactgttcaagatataaccacatcgtgggatgcactttctcaaaccaaggctgctatggtagatacctggatgattcttgggttaatgctccaatctccaaatccactaaatcacgaaaagagaaatctcgtagtcctctcagggccaccaccctggagagtaatgtgaagaaaaataatcgtgtggaatttcgtgaacctttggtttcttatagggaaatccatggtgcaccttccaatttcagttccagccatctggaatcaaagcacgtatactgtgtagatgttaatgaagaaaagactgagagcggtaactggatgataggcagtcgagaagaacggaatatacggagctgtgattttgagagctcccaatcatctgtcatcaatgatacagttgttaggtttttaaatgatcgaccagcaattgatgcattgcaaaattctgaatgtttgattaggatgggagcttctatgagaactgaggaagaaatgcctaacagaacaaaaggaagtgagaataatttgaagctttctgtgaataacatggcccatgatactgatccaaaagcgttacgactaactgactcttctccatcctctactagtacttctaattcccaaag

SEQ ID NO: 116542 - DNA, 6513 bp, Homo sapiens
  Payload ID: 2735
  Gene Symbol: CEP41
  Gene Name: centrosomal protein 41kDa
  Uniprot ID: Q9BYV8
  ENST ID: ENST00000223208
  CDS Start-End: 272-1393
aaggctggagccggcgagccccagcccagagaacaaaaggcctcgctagccggcgtcccgcgttgcccttggcaaccattgagcggcgtcttgcccttctgcgaccctgagatgagagagtaaacggggcccccattggccggccggggaagacgggccaatcggagaagagggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcctctcccctcaggaggccacctcaggaaggattttgacaggtgaccataaaaaccagaggtgtgacaggctctagtctcctccctgttgtttacagcatatttaagtcttgtgaaactgtataggaaaaaagtatctacgtttttagtttttttgttttgtttttttttaataaggtccagcttgttgggtctctctgtgttgttttgtaaatacttcagtcacatctgcccgtgtgcctgtccctgccaccttttcattcactgttcttgacttcatgaaggcttctccgggcagtcttggtgtgagaagctgtttccaagggtgcagatgagccttaggttccagccgcctgcagaccccaccccagcaggctcactcagcaaggagctctctgcccagcatattgcaggccctgttttgagtatggaagccagtgcctgtgtactcactgaaattgaagatgaggaaagtagctgtacactcactgaatgctcccccttactagatatttcctggagccagaaaggtatgcatgtgggtgtcttcacaccggggaggagggcctctcatgggaaagccctggccaccacaccggcctgtgccccttgaagcccaccaaagcggccctcacttgtggtcagtatatcagttatgacgcccattgcccagcttcagtccatccatgttagatggacagaaattatggccagttgaaaataccagctttggttggacaactgtggacacacaaggtgaagaggactccgaagtcctttgtcagggctgacaacctcgtaagcccttgcttagaaatacagtattagtctaattgagtaattagtgcaatttcctgcttacttttcattctcatgactgaactgtgattaggaagttgtgattatagattctggttttggccggaattttgaatcagcattaattgaattgctaaatgactgacattcattccatttaattgggggaacaaaaggcctcaggtaaggatgaggaactctgaaatcagatggaaaagagcggtgttaatttttatggtctgtgatcgtagctgtgataagggactgaggaataaattgtgctctttgtcatggcaaccagcttctgaaaagcccactgaaaattgcctgtcctgctggtaactgctacggggtaagatttgccttaacagtactattttctcgccaccaaaaaaaaaaaaaaaaaaaaaaaaaaatgcaccacagtatttctagcatgggggctgtgtttgtatgagaaataaacgtaataaatatctcatagagacatatggaaaaataactttcagattcagcccagttctgttttagagtgtgtttattcttctctacttgatttccaaagtgcaacattttccgatgctttagaaatcaaacaaaccagggacattgttcagatgtcaagccatgcccaattttccacaagattcaagaatcttgtataaaattcagccaacgtacacatagctttaatgaggagcctgtcatgtttccccataaatttattgcctgagaacttagttcagcctttgctaatgccaaaatgctctggctttgtattttctttacagcatagatagaaaaatgcacatttttccacactcagctttcccctagcatggacaagattttcagccatttttgccacatatacatttttaaggaaaaaagatttttctctgtaagaaagttctggttatgctgttttaaaggtgacttgtcaggagttgagacttccctgccggattctattttgaaagtaaatggtcttccctccttgttccgattctgcgttcccatcgtcagacaactttggagtattagaaaccactgtatatatgtggaaagccaggtcagccagacctgttagaattggtgtgcactcacctgagagatctggcaggttggatatatttatgtgtatttctccacagtgcttgctttgccctgttggtaaggattttaaataaccatgctcaaaagagctgttctaatctgcgttttgcatgttaagtgttaatatcaaacattctttacgtgctcgaggtattgcttttaacattctactttgccagtttcttcattagattaattgacatgtattatttaaatgaccagtgatgctttgtgcaattatgaatgttgaagattaaagtacatagttactaatttgtcgtttgctattaatatgctgaaaactgccaacttctctcttcttttctgtcgagatgatttgggggagccacaggagactggtgtgatttttgctgcatctcctaggaaagcattttttaaaaaaaataaatgaatcaggaaatcagtccaattagggcagggggcctcagctctccagtcagaaagcctggatttcttttcctgctcaggctgggactgaagccaccttcaacaactggatcatggcttcctaccagcgtctcaggggttgactagctgcccttgtctggggcttgtgaaccctgagacagaaggtgcttcatcgatgtacaactacagcaccctgaacagcagtgatggccaaagtttaaataataccttaaatgctttaaaggggtttgtgtttaaggaagggagaaaagaaaaaaagaaaggaagggagaaagaagcaaggaaatgggaagaagggagggcagagagaagaaaagaagcagaaagcgagagagaaaggagaaagctacattacttatttgaaaacaaaaggaacaccctgggctgtaataatgtcaggctcaatctcttgaaaaagtatggaatgatttaaatggcctgcattcattttatcttttatctttttttttttttttaacctttagtggttagccaggaccagcacgatcatattgggcttggtataaatccgaatgaaaagagaccaaataacattcattagttgctcagggatttttcctgtggtgctatttaaattatacaaaaattcttaagactttaggctactcgaccaagaaaacagaacaaaacaaaaaatcgtgttttctctaattcccttgtggaatgtaagtgaaatcagagtcctaggctaggaagaaatacgtaggtaatttttcttgtgttggttttggtttctgtcatgttgtttattggctatagattctgtcttttatgttatctgacttttttagagcgaataattagtttctgtccacctggatttaaatccatgaccaccttcttgctctactctgaagataatcagtaagaacctttctttctccagttctaaaacgttctcagtgtctttaatgtgtgtttattttcttcccaattctttcaaagatttaactcccacgatacttttttttccccaggaaacaccgcaaatgtgtggaatataattcaccagtttaattatgtgagcatgttgagtacttacatgcaggtccattaatttttcactaacaattattttttcatgcaaaagcaataaataacattgtgcttccaaaatgttcagaatacatttgggtagtaatactttcctagatttacaataattattgaaattattattatgacatctttaaatggatacacaggtcagttacaacataaaaaatgtaatggtggaaatttgtcagccttgaattcaggcagaacaggattcggtgcatgattttatgtgttttcgaaacggtgtctgtcacattgtgatcccctgatggctcccctctctgttgctgatcctctttgttctgtacagaagcaaattctcacctgtgtaacatcctgaagcacctggtaaaatgtgaggcaaagagaggccacttctcaaatgctgtggacggatgggctgcatcttttaaaggatatcaatatgtcttcctgttgcaattattttgactataagctcccagagagtgaaaatcaccaaccctgtgacagtggcccttaataagtgttcatgaataaatgaattgaacctgtcaagattgaagtttggatgtgatgcccactgtggtggccactcagtgctagtctgtcattctggagacccagaaagctcgttatcttctgtcccccttgtgtatcctgcctttgtgggcgaggcattcaaaaccctgaggtttttagatctccctctacaggaagtacccagagagctgctgggggtgttattaccctgtctctgccaggcttaaagtatcctcccaaattcagcacgcaaaggtcacacaccacccccatcttaagagtaggttttctcttttgtttcaaatcttgaagatttccagaaaataataatactagccaatgtttgtggagagcttactttgctcctagattcttcattatatgttttgacccatttaatttccacaacagtctgatgaggcaggcacccccattttcagatgaggagactgaggttcgggtagaaattaagtgactcaggtttgccttcagtctctgaccaagggtttgaaaagccaggagccagcctgagaactgtggctccagagggtgttctttcagccactccgctctatgcttctcactctgggtgggcacaaccatgttctcctttggtgatgcctctaacttaccgtgaaaatgtacctttcccttcgctattggcttcccttccctcctagtcagccgagattcttttgaaaactttcctccgcttgcctgcacaaaaggcgatggaaattcaggaactgaaacatctgctctggggaatgcgtatttccacatttccaccgcctgtgtctgctgtcttatcttgaagacaggtgctccagggcttccgaggttattttgtctgttaatggacaccttgcaaagtaccacttaaggaatgagaattacaaacttttaattatattgtagggggaaaaaagtaggctgttttcctgataggtctagccattcattcagtaaaccatattgatatga

SEQ ID NO: 116543 - DNA, 1087 bp, Homo sapiens
  Payload ID: 2735
  Gene Symbol: CEP41
  Gene Name: centrosomal protein 41kDa
  Uniprot ID: Q9BYV8
  ENST ID: ENST00000343969
  CDS Start-End: 30-935
aaccccgaacgtggtcggttggagaaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcc

SEQ ID NO: 116544 - DNA, 592 bp, Homo sapiens
  Payload ID: 2735
  Gene Symbol: CEP41
  Gene Name: centrosomal protein 41kDa
  ENST ID: ENST00000471201
  CDS Start-End: 92-301
gaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggccgtactgttcctgtatttcccccaagccttgtttcttctgccacaaaaaccctcagctctttcatctctacccatctaacccctaattgcaactgtgatccacccttctgaagtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgca

SEQ ID NO: 116545 - DNA, 827 bp, Homo sapiens
  Payload ID: 2735
  Gene Symbol: CEP41
  Gene Name: centrosomal protein 41kDa
  ENST ID: ENST00000472739
  CDS Start-End: 343-827
gtcattcagacatttccatgccgtacagatatttatccttgcaaatatcccacttgatgggcaggtgaaaatattatctctgtcttagaagaggaaattgtggcacggggattttgtgatttattcggagttcaataaaggagagagaactaggattatatacaggatgaggaagtcaatattggagatctggtgccaagtctggtgtactgtttcttaggccgtactgttcctgtatttcccccaagccttgtttcttctgccacaaaaaccctcagctctttcatctctacccatctaacccctaattgcaactgtgatccacccttctgaagtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaat

SEQ ID NO: 116546 - DNA, 3161 bp, Homo sapiens
  Payload ID: 2735
  Gene Symbol: CEP41
  Gene Name: centrosomal protein 41kDa
  Uniprot ID: Q9BYV8
  ENST ID: ENST00000489512
  CDS Start-End: 91-255
aggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtgcctgtgtgtatcttaccagctccccagcactgccagactgtgccatgaatggattatgcttctgatgaaatccctggctgcgttttgttcagtcaccaccgcagggttcttgtatattctcaagcaccctctctgggtttctgttttgcagcactgcaggctgattaagggacactttccaaaccacagggctctccctttattagtccccacagtctttcattggctgcattgtcctcccatttctatctatattcaatctaatttccaatttctttagctttctgaaattctgtaggctttctccactcagtcttttctagccttatttttgtctttttaaaaattcaccttccttttattatctctagacaaactattcattccctcttttcttctttaggctttacttttcctgaatatttgctaatagccttgactgtaagcatcaaactcattatagactaggtactcttcatttttatttgttgtttaattctgtttcttccgtcaaaggaagaaatatatgtgaaaggcttttataaaccagaaagcactatacacacatatcacttattgaggttaacaaaggaccactgtgcctcttttcatgctttctgctcttccaagccaagagaacttctccatagaggagggaaatattgaagaaaaataaagccatggagttgtctcttagcaactgagttcgtgccttataaatctcatctactttagattactgctgcacaaaatcacttgcttttcttattggctcagtataaataatgttattaaattataggaaaacaatggaaaaaatctaatgaatgactcattcactgaatcagttgcactctgtgtttgcacagcactgttgctatagtcgggttgtttcttcctcttgattctaattgtaaagttttgttatatatcttttatcacaactttagttgtaagtaaacaaagtagaagctaaatgctaccttatacatttataggttgcttaagtcgtgaagcaatatgagtcatatatgtagcacataacatatactgtatataagtcaagttgtacatagtttaaagaaaatcaggtgtgcagaaactcagaccaaattgggaagtatttgcattataaaataactcattataaggatttttcagttagtagatctccatagtaaatttcattcagcaaatgtgtatttttcctatttatttatttatttatttattgagatgaagtctcgctctgttgcccaagctggagtgcagtggcgtgatcttggctcactgcaacctctgcctcccaggttcaagcgattcttctgcctcagcctcctgagtagctgggactacaggtgcgcaccaccatgcctggctaatttttatatttttagtagagacggggttttactatgttggtcaggctggtctcgaactcctgaccttgtgatcctcccgcctcggcctcccaaagtgctgggattacaggcgtgagccactgtgccaggtctagttatttatttatttattgtagagatgggctctcactgtgttggccagggtggtcttgaactcctggcctcgagcaatccttccacctcagtctcccaaagtgctgggattacaggtgtgagctatcacacctggccatttttttttttttttttttttttgagatagagtctcactctgtcacccgcattgtagtgcagtggcgcattcttgctcactgcaacctccccttcctgggctcaggggatcctcctacctcagcctctcaagtagctgggactacagggatgtgccaccatgcctggctagtttttgtgtatgtgtgtgttttgtagagacgaggtctcactattttgcccaggctggtccggaactcctgggctcaagcaatcctgcctcctcagcctcccaacgtgctgggattgcaggcatgatccagtgcacctgaccatcattcagcaagtatttttgagtgtctcctatgctagacaatggaagggataaagattattcatacgtgtgtgtgtgtgtgtgtgtgtacgtgcccataaatagtccttggctttctgtctagtaaggtaggtaagacaatacagtgataaatgccttgtgagttgtaagccgagtgctatagaggctcagaggagggaaaggtcacttcctgctgagtgagctcttacgagtatgtggcaaggtgatacgttagagaatgcaagactaagagtttgtcaagttaagtaattaaggcaacattaagaggtagtgagttggtgtccagtgctagagcaaggagtttcagctttagttaggaagcaatggggagccactgacttttttttttctttttgatcaaaaagtcttatctgggaaaatgtatctggcagtaatgtgtaatttcaattttttttaaaaaaaattggttcttggatagtcttttaggcttcttttgtatgaaacaaagccatgtttataaataagtgaattatgaaatggattcatttccaatctttttaaaaggtagtcagaaactatcttcagatgcaattagatacagtaagataggctgcatagttaagatgtaagcagtttacacagtgggataaaaatgctacttttcatactttctcaaaccatttttaggggtatttttgtgtcagccatcctgctatctcatttgtccaattaaagcaaggaagaaatcctccattctccttttttccccattcttggatagaatgaatgtctatagtgaaaagaactcatcagtagtcctctcagatttggtctgaatttcaccaaatatttgtataattgcaaaaaacttgtttctcagccttctcctttagggggaaaacaaatagagggcatgatggcctacctccctgcattgtggtgagggtcagctgatacaaaataaagtgttaagtgtaattaccctgaaatgtttgtaattaat

SEQ ID NO: 116547 - DNA, 561 bp, Homo sapiens
  Payload ID: 2735
  Gene Symbol: CEP41
  Gene Name: centrosomal protein 41kDa
  ENST ID: ENST00000475282
  CDS Start-End: 140-561
gtgtatcttccccacaaaaagatcgtcagcgggggcaggggagataaaaggaggaggaaagcctagacttgaaaaacaaactgatagaaaatgatcatctgtatctcctggaacttgtcaatgttttgggggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgct

SEQ ID NO: 116548 - DNA, 516 bp, Homo sapiens
  Payload ID: 2735
  Gene Symbol: CEP41
  Gene Name: centrosomal protein 41kDa
  ENST ID: ENST00000469826
  CDS Start-End: 322-516
ttccgccgcccggaaggcgggaaggggccggcgtgaggaggggtcgggatgcaggggcggggcgggccgggcttgggggccgcggggcagcgttcaggaccccgttttgaggagcgatctctccccgcgtacgcacgccagtacttgtgactgcgaggagcgaagtacccaaagacacagcccttgccctcaaatggcttacagtctcggagtgacagttacaaaacagaaaagacaaaggaagcgctgcacactaatggcacgtgttgaaagccagccagcatctctgattgtggggatacaggaagagcaggatatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgat

SEQ ID NO: 116549 - DNA, 1269 bp, Homo sapiens
  Payload ID: 2735
  Gene Symbol: CEP41
  Gene Name: centrosomal protein 41kDa
  ENST ID: ENST00000484549
  CDS Start-End: 62-439
aagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcctctcccctca

SEQ ID NO: 116550 - DNA, 689 bp, Homo sapiens
  Payload ID: 2735
  Gene Symbol: CEP41
  Gene Name: centrosomal protein 41kDa
  ENST ID: ENST00000492389
  CDS Start-End: 111-689
cttgtttcttctgccacaaaaaccctcagctctttcatctctacccatctaacccctaattgcaactgtgatccacccttctgaagtaagtgattctgtgaggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgat

SEQ ID NO: 116551 - DNA, 557 bp, Homo sapiens
  Payload ID: 2735
  Gene Symbol: CEP41
  Gene Name: centrosomal protein 41kDa
  ENST ID: ENST00000477003
  CDS Start-End: 14-557
atccataatctctatggttacccacaaggtgcaccagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttacc

SEQ ID NO: 116552 - DNA, 6222 bp, Homo sapiens
  Payload ID: 2735
  Gene Symbol: CEP41
  Gene Name: centrosomal protein 41kDa
  Uniprot ID: Q9BYV8
  ENST ID: ENST00000541543
  CDS Start-End: 245-1102
agagaacaaaaggcctcgctagccggcgtcccgcgttgcccttggcaaccattgagcggcgtcttgcccttctgcgaccctgagatgagagagtaaacggggcccccattggccggccggggaagacgggccaatcggagaagagggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactgattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcctctcccctcaggaggccacctcaggaaggattttgacaggtgaccataaaaaccagaggtgtgacaggctctagtctcctccctgttgtttacagcatatttaagtcttgtgaaactgtataggaaaaaagtatctacgtttttagtttttttgttttgtttttttttaataaggtccagcttgttgggtctctctgtgttgttttgtaaatacttcagtcacatctgcccgtgtgcctgtccctgccaccttttcattcactgttcttgacttcatgaaggcttctccgggcagtcttggtgtgagaagctgtttccaagggtgcagatgagccttaggttccagccgcctgcagaccccaccccagcaggctcactcagcaaggagctctctgcccagcatattgcaggccctgttttgagtatggaagccagtgcctgtgtactcactgaaattgaagatgaggaaagtagctgtacactcactgaatgctcccccttactagatatttcctggagccagaaaggtatgcatgtgggtgtcttcacaccggggaggagggcctctcatgggaaagccctggccaccacaccggcctgtgccccttgaagcccaccaaagcggccctcacttgtggtcagtatatcagttatgacgcccattgcccagcttcagtccatccatgttagatggacagaaattatggccagttgaaaataccagctttggttggacaactgtggacacacaaggtgaagaggactccgaagtcctttgtcagggctgacaacctcgtaagcccttgcttagaaatacagtattagtctaattgagtaattagtgcaatttcctgcttacttttcattctcatgactgaactgtgattaggaagttgtgattatagattctggttttggccggaattttgaatcagcattaattgaattgctaaatgactgacattcattccatttaattgggggaacaaaaggcctcaggtaaggatgaggaactctgaaatcagatggaaaagagcggtgttaatttttatggtctgtgatcgtagctgtgataagggactgaggaataaattgtgctctttgtcatggcaaccagcttctgaaaagcccactgaaaattgcctgtcctgctggtaactgctacggggtaagatttgccttaacagtactattttctcgccaccaaaaaaaaaaaaaaaaaaaaaaaaaaatgcaccacagtatttctagcatgggggctgtgtttgtatgagaaataaacgtaataaatatctcatagagacatatggaaaaataactttcagattcagcccagttctgttttagagtgtgtttattcttctctacttgatttccaaagtgcaacattttccgatgctttagaaatcaaacaaaccagggacattgttcagatgtcaagccatgcccaattttccacaagattcaagaatcttgtataaaattcagccaacgtacacatagctttaatgaggagcctgtcatgtttccccataaatttattgcctgagaacttagttcagcctttgctaatgccaaaatgctctggctttgtattttctttacagcatagatagaaaaatgcacatttttccacactcagctttcccctagcatggacaagattttcagccatttttgccacatatacatttttaaggaaaaaagatttttctctgtaagaaagttctggttatgctgttttaaaggtgacttgtcaggagttgagacttccctgccggattctattttgaaagtaaatggtcttccctccttgttccgattctgcgttcccatcgtcagacaactttggagtattagaaaccactgtatatatgtggaaagccaggtcagccagacctgttagaattggtgtgcactcacctgagagatctggcaggttggatatatttatgtgtatttctccacagtgcttgctttgccctgttggtaaggattttaaataaccatgctcaaaagagctgttctaatctgcgttttgcatgttaagtgttaatatcaaacattctttacgtgctcgaggtattgcttttaacattctactttgccagtttcttcattagattaattgacatgtattatttaaatgaccagtgatgctttgtgcaattatgaatgttgaagattaaagtacatagttactaatttgtcgtttgctattaatatgctgaaaactgccaacttctctcttcttttctgtcgagatgatttgggggagccacaggagactggtgtgatttttgctgcatctcctaggaaagcattttttaaaaaaaataaatgaatcaggaaatcagtccaattagggcagggggcctcagctctccagtcagaaagcctggatttcttttcctgctcaggctgggactgaagccaccttcaacaactggatcatggcttcctaccagcgtctcaggggttgactagctgcccttgtctggggcttgtgaaccctgagacagaaggtgcttcatcgatgtacaactacagcaccctgaacagcagtgatggccaaagtttaaataataccttaaatgctttaaaggggtttgtgtttaaggaagggagaaaagaaaaaaagaaaggaagggagaaagaagcaaggaaatgggaagaagggagggcagagagaagaaaagaagcagaaagcgagagagaaaggagaaagctacattacttatttgaaaacaaaaggaacaccctgggctgtaataatgtcaggctcaatctcttgaaaaagtatggaatgatttaaatggcctgcattcattttatcttttatctttttttttttttttaacctttagtggttagccaggaccagcacgatcatattgggcttggtataaatccgaatgaaaagagaccaaataacattcattagttgctcagggatttttcctgtggtgctatttaaattatacaaaaattcttaagactttaggctactcgaccaagaaaacagaacaaaacaaaaaatcgtgttttctctaattcccttgtggaatgtaagtgaaatcagagtcctaggctaggaagaaatacgtaggtaatttttcttgtgttggttttggtttctgtcatgttgtttattggctatagattctgtcttttatgttatctgacttttttagagcgaataattagtttctgtccacctggatttaaatccatgaccaccttcttgctctactctgaagataatcagtaagaacctttctttctccagttctaaaacgttctcagtgtctttaatgtgtgtttattttcttcccaattctttcaaagatttaactcccacgatacttttttttccccaggaaacaccgcaaatgtgtggaatataattcaccagtttaattatgtgagcatgttgagtacttacatgcaggtccattaatttttcactaacaattattttttcatgcaaaagcaataaataacattgtgcttccaaaatgttcagaatacatttgggtagtaatactttcctagatttacaataattattgaaattattattatgacatctttaaatggatacacaggtcagttacaacataaaaaatgtaatggtggaaatttgtcagccttgaattcaggcagaacaggattcggtgcatgattttatgtgttttcgaaacggtgtctgtcacattgtgatcccctgatggctcccctctctgttgctgatcctctttgttctgtacagaagcaaattctcacctgtgtaacatcctgaagcacctggtaaaatgtgaggcaaagagaggccacttctcaaatgctgtggacggatgggctgcatcttttaaaggatatcaatatgtcttcctgttgcaattattttgactataagctcccagagagtgaaaatcaccaaccctgtgacagtggcccttaataagtgttcatgaataaatgaattgaacctgtcaagattgaagtttggatgtgatgcccactgtggtggccactcagtgctagtctgtcattctggagacccagaaagctcgttatcttctgtcccccttgtgtatcctgcctttgtgggcgaggcattcaaaaccctgaggtttttagatctccctctacaggaagtacccagagagctgctgggggtgttattaccctgtctctgccaggcttaaagtatcctcccaaattcagcacgcaaaggtcacacaccacccccatcttaagagtaggttttctcttttgtttcaaatcttgaagatttccagaaaataataatactagccaatgtttgtggagagcttactttgctcctagattcttcattatatgttttgacccatttaatttccacaacagtctgatgaggcaggcacccccattttcagatgaggagactgaggttcgggtagaaattaagtgactcaggtttgccttcagtctctgaccaagggtttgaaaagccaggagccagcctgagaactgtggctccagagggtgttctttcagccactccgctctatgcttctcactctgggtgggcacaaccatgttctcctttggtgatgcctctaacttaccgtgaaaatgtacctttcccttcgctattggcttcccttccctcctagtcagccgagattcttttgaaaactttcctccgcttgcctgcacaaaaggcgatggaaattcaggaactgaaacatctgctctggggaatgcgtatttccacatttccaccgcctgtgtctgctgtcttatcttgaagacaggtgctccagggcttccgaggttattttgtctgttaatggacaccttgcaaagtaccacttaaggaatgagaattacaaacttttaattatattgtagggggaaaaaagtaggctgttttcctgataggtctagccattcattcagtaaaccatattgatatga

SEQ ID NO: 116553 - DNA, 3315 bp, Homo sapiens
  Payload ID: 2735
  Gene Symbol: CEP41
  Gene Name: centrosomal protein 41kDa
  Uniprot ID: Q9BYV8
  ENST ID: ENST00000616628
  CDS Start-End: 245-409
agagaacaaaaggcctcgctagccggcgtcccgcgttgcccttggcaaccattgagcggcgtcttgcccttctgcgaccctgagatgagagagtaaacggggcccccattggccggccggggaagacgggccaatcggagaagagggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtgcctgtgtgtatcttaccagctccccagcactgccagactgtgccatgaatggattatgcttctgatgaaatccctggctgcgttttgttcagtcaccaccgcagggttcttgtatattctcaagcaccctctctgggtttctgttttgcagcactgcaggctgattaagggacactttccaaaccacagggctctccctttattagtccccacagtctttcattggctgcattgtcctcccatttctatctatattcaatctaatttccaatttctttagctttctgaaattctgtaggctttctccactcagtcttttctagccttatttttgtctttttaaaaattcaccttccttttattatctctagacaaactattcattccctcttttcttctttaggctttacttttcctgaatatttgctaatagccttgactgtaagcatcaaactcattatagactaggtactcttcatttttatttgttgtttaattctgtttcttccgtcaaaggaagaaatatatgtgaaaggcttttataaaccagaaagcactatacacacatatcacttattgaggttaacaaaggaccactgtgcctcttttcatgctttctgctcttccaagccaagagaacttctccatagaggagggaaatattgaagaaaaataaagccatggagttgtctcttagcaactgagttcgtgccttataaatctcatctactttagattactgctgcacaaaatcacttgcttttcttattggctcagtataaataatgttattaaattataggaaaacaatggaaaaaatctaatgaatgactcattcactgaatcagttgcactctgtgtttgcacagcactgttgctatagtcgggttgtttcttcctcttgattctaattgtaaagttttgttatatatcttttatcacaactttagttgtaagtaaacaaagtagaagctaaatgctaccttatacatttataggttgcttaagtcgtgaagcaatatgagtcatatatgtagcacataacatatactgtatataagtcaagttgtacatagtttaaagaaaatcaggtgtgcagaaactcagaccaaattgggaagtatttgcattataaaataactcattataaggatttttcagttagtagatctccatagtaaatttcattcagcaaatgtgtatttttcctatttatttatttatttatttattgagatgaagtctcgctctgttgcccaagctggagtgcagtggcgtgatcttggctcactgcaacctctgcctcccaggttcaagcgattcttctgcctcagcctcctgagtagctgggactacaggtgcgcaccaccatgcctggctaatttttatatttttagtagagacggggttttactatgttggtcaggctggtctcgaactcctgaccttgtgatcctcccgcctcggcctcccaaagtgctgggattacaggcgtgagccactgtgccaggtctagttatttatttatttattgtagagatgggctctcactgtgttggccagggtggtcttgaactcctggcctcgagcaatccttccacctcagtctcccaaagtgctgggattacaggtgtgagctatcacacctggccatttttttttttttttttttttttgagatagagtctcactctgtcacccgcattgtagtgcagtggcgcattcttgctcactgcaacctccccttcctgggctcaggggatcctcctacctcagcctctcaagtagctgggactacagggatgtgccaccatgcctggctagtttttgtgtatgtgtgtgttttgtagagacgaggtctcactattttgcccaggctggtccggaactcctgggctcaagcaatcctgcctcctcagcctcccaacgtgctgggattgcaggcatgatccagtgcacctgaccatcattcagcaagtatttttgagtgtctcctatgctagacaatggaagggataaagattattcatacgtgtgtgtgtgtgtgtgtgtgtacgtgcccataaatagtccttggctttctgtctagtaaggtaggtaagacaatacagtgataaatgccttgtgagttgtaagccgagtgctatagaggctcagaggagggaaaggtcacttcctgctgagtgagctcttacgagtatgtggcaaggtgatacgttagagaatgcaagactaagagtttgtcaagttaagtaattaaggcaacattaagaggtagtgagttggtgtccagtgctagagcaaggagtttcagctttagttaggaagcaatggggagccactgacttttttttttctttttgatcaaaaagtcttatctgggaaaatgtatctggcagtaatgtgtaatttcaattttttttaaaaaaaattggttcttggatagtcttttaggcttcttttgtatgaaacaaagccatgtttataaataagtgaattatgaaatggattcatttccaatctttttaaaaggtagtcagaaactatcttcagatgcaattagatacagtaagataggctgcatagttaagatgtaagcagtttacacagtgggataaaaatgctacttttcatactttctcaaaccatttttaggggtatttttgtgtcagccatcctgctatctcatttgtccaattaaagcaaggaagaaatcctccattctccttttttccccattcttggatagaatgaatgtctatagtgaaaagaactcatcagtagtcctctcagatttggtctgaatttcaccaaatatttgtataattgcaaaaaacttgtttctcagccttctcctttagggggaaaacaaatagagggcatgatggcctacctccctgcattgtggtgagggtcagctgatacaaaataaagtgttaagtgtaattaccctgaaatgtttgtaattaat

SEQ ID NO: 116554 - DNA, 4173 bp, Homo sapiens
  Payload ID: 2736
  Gene Symbol: CEP44
  Gene Name: centrosomal protein 44kDa
  Uniprot ID: Q9C0F1
  ENST ID: ENST00000296519
  CDS Start-End: 53-1225
aggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaagaatgatgaatttatagagtttaatgaagttagtgaagactacgcttcttgtagtgacatggaccttctgaatcctcacagaaaaagcgaagtagagaggccagcaagtattcctctgtcctctggctatagtacagcatcatcagattcaactcccagagcctctactgttaattactgtggtttgaatgagatttcagaggaaacaacaatccagaaaatggaaaggatgaaaaaaatgtttgaagaaactgcagagttactgaaatgtccaaatcactacttgtaggattttctacatgaacttttttctaggactttggttactatacatattgtatattttaagaattctttatacaattttaatatactgcaatactgcagtttttgacaatttggattccatttggtatatgaatttttgcattcattattgaataactcttttaatatttttgagcaatgattatactgctttaccttgtgtcactttttttttttttaggaaaaactcatgttccagtatatttctcttacagagtgaagtcattacagcactgtatttctgtgttgacatttgttggcagtgtgctaagtaatgttttttaaagcacaggcttgaggactatggtttacatcctgttggaaacattccaaatgggacttgtgtattatacccaggaggctctcatatataccatcttggcatctgtactgatgaataagttataatgaacagttaaaaatgctcattgaaaattaaataaaacaaaaaggcagttatttcatgcttggtcaaaaacatcaatacctttccaattaacactgagaaattaaggttaagattctccttttgtactgggaaacaggctggaggactatggtcctcaagtttagaccaagaggactatggtctcaaggttcaccatgagaaatgtgttgaacattttagtatgctctattgtataatttttttggagggggggatggagtttcgctgttgttgcccaggctggagtgcaatagcacgatcttggctcaccgcaacctctgcctaccgggttcaagtgattcttgtgcctcagcctcctgagtagctgggattataggcatgcaccaccatgcccagctaattttgtatttttattagagacagggtttctccgtgttggtcaggctggtctcaaactcctgacctcaggtgatctgcctgtcttggcctccggcgtaacactttttaagaccagtgtaacagaaagagaatgtagccattctagccaccgttaaaagatacacagtgaggtgttgtgttttgtttttttaatgatgaaaagttacacattttttggagagaaaagtcttagctgaaggtaaatcaatggaaaaatgaaatttatttttaatattactactatatgaattatctttttttaaacttgtagataaaagtgttccagtaatcagaaaatcctcaagaaaattgacttcattatttggaaggaaaattagtattttttttaatattatatggaccatctgattatattttatttattcatctatttatggtatgtatgtataattctatattacactgtcaaatataaaatattgttatatgagtagaaatcacttaaattttttttgtgtttgtgaatttgaaacagtgtaagaaatcacttttaagaaaacatttttagaattcctttgttttttttttttttctttttgaaacagggtctcactctattgcccaggctggagtgcactggcgtgatctcggctcactgcaccttctgcctaccgagttcaagcgattcttgtgcttcagcctcctgagtagctgggactataggcctgtaccgtcatgcctggctaatttttgtatttttgtagagacagggtttcaccatgttgcccagtctgttctcaaactcgtgagctaaagctactcgcccacctggatgtcccaaagtgctagattccatgggtgagtcaccatgcttggccacatttttagtattctaataaacagttggtcatcagaactttaaaatggtagcctacagaaacatacaattttgaatttaacagagtttcagtaaatatttccagaattaatgaagcatgttagctttaattttttcaattgtgagagaagtacatttataaaaattaagaggttaagaggttatagttataagggaaaaaacttctgtatcgattaactcctaaaatatcagtaccagcatggaattatagcaccaccttgtggttaacatgccagtattttaccttttgttaaaacaagtgatttcccatcaaacaggataatattttttcccttttgaaaaattcaattttaaaaagaaacatttttgaagttttcttatggaagatagaaaaaaagttaagtctctttctaccctttctttttttctttatatagtgcagatatacacacagagaagggacttaaaacatttctaatctcctagtttatatacagtgtgcaaaatataagtaagtatatattgaaaatataaaatatttcatatatgttatcaggtggaaatttagaatccaaattttcttaaactttaataacttgtctaacaactctctaatagggactaaaaatcaactcaatatatcatacatttacacttacaaagagtctttatctagacaacataatttttggaaaaataaagcaaattcaactttattggagttattggacagatcagcaaattgttattttaaaaagttttcttgtttaggcaatttggtaagtggtttctagttataaactagccactgttgattaacttgagaaggtgaagcaggggagttctgaagagattacctagagctacataaccctaagttaagtaaaattttcactttcattcttttcattctctcataaactggttgaaaaaacactgtactaccaacaaaggtgtcagttgcttgtgctgccctgtctatgttatgctctgaataggtctcggtaaagattatatggaaatactataaagaatacataaggtaaaatactagtcagaaagggttcagaagaagttagcatcaactgtatgaaaattctaggtaaagctaagtactattgagttggaaaaaagtaattctatcatgtttgcttgttttcctctactgtttttaatgtgatgttgtaatatattttaaaaataaaacttgaaaacgttggga

SEQ ID NO: 116555 - DNA, 3824 bp, Homo sapiens
  Payload ID: 2736
  Gene Symbol: CEP44
  Gene Name: centrosomal protein 44kDa
  Uniprot ID: Q9C0F1
  ENST ID: ENST00000396791
  CDS Start-End: 305-1477
gagcacagagaagctcccagctttgaaggtcttgcggtggtgcgtggcgggcaggaacccacaattccaaatacaaacggtcggcgcgagaagcgcttctgggcgcaggcgcctggctgtagcgactggttgcgggaggctggactctggtgactgtaagcatcaagtgtacctgatttgtgaacctatcttgcttcagttggtttcctcctaaatattaggcagatgggattggctggtctgtgctctgctaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaagaatgatgaatttatagagtttaatgaagttagtgaagactacgcttcttgtagtgacatggaccttctgaatcctcacagaaaaagcgaagtagagaggccagcaagtattcctctgtcctctggctatagtacagcatcatcagattcaactcccagagcctctactgttaattactgtggtttgaatgagatttcagaggaaacaacaatccagaaaatggaaaggatgaaaaaaatgtttgaagaaactgcagagttactgaaatgtccaaatcactacttgtaggattttctacatgaacttttttctaggactttggttactatacatattgtatattttaagaattctttatacaattttaatatactgcaatactgcagtttttgacaatttggattccatttggtatatgaatttttgcattcattattgaataactcttttaatatttttgagcaatgattatactgctttaccttgtgtcactttttttttttttaggaaaaactcatgttccagtatatttctcttacagagtgaagtcattacagcactgtatttctgtgttgacatttgttggcagtgtgctaagtaatgttttttaaagcacaggcttgaggactatggtttacatcctgttggaaacattccaaatgggacttgtgtattatacccaggaggctctcatatataccatcttggcatctgtactgatgaataagttataatgaacagttaaaaatgctcattgaaaattaaataaaacaaaaaggcagttatttcatgcttggtcaaaaacatcaatacctttccaattaacactgagaaattaaggttaagattctccttttgtactgggaaacaggctggaggactatggtcctcaagtttagaccaagaggactatggtctcaaggttcaccatgagaaatgtgttgaacattttagtatgctctattgtataatttttttggagggggggatggagtttcgctgttgttgcccaggctggagtgcaatagcacgatcttggctcaccgcaacctctgcctaccgggttcaagtgattcttgtgcctcagcctcctgagtagctgggattataggcatgcaccaccatgcccagctaattttgtatttttattagagacagggtttctccgtgttggtcaggctggtctcaaactcctgacctcaggtgatctgcctgtcttggcctccggcgtaacactttttaagaccagtgtaacagaaagagaatgtagccattctagccaccgttaaaagatacacagtgaggtgttgtgttttgtttttttaatgatgaaaagttacacattttttggagagaaaagtcttagctgaaggtaaatcaatggaaaaatgaaatttatttttaatattactactatatgaattatctttttttaaacttgtagataaaagtgttccagtaatcagaaaatcctcaagaaaattgacttcattatttggaaggaaaattagtattttttttaatattatatggaccatctgattatattttatttattcatctatttatgggtctcactctattgcccaggctggagtgcactggcgtgatctcggctcactgcaccttctgcctaccgagttcaagcgattcttgtgcttcagcctcctgagtagctgggactataggcctgtaccgtcatgcctggctaatttttgtatttttgtagagacagggtttcaccatgttgcccagtctgttctcaaactcgtgagctaaagctactcgcccacctggatgtcccaaagtgctagattccatggaattttcctgcatggagtgctacatcctcttgttccagtctcagctggctgctccgtgggcatacttcatacctttcatcacagagctttgcttggcctctctcctgtgtgtaatctctgtttcttggatcctgtgcttaccttttcctgctgtactctgatgtttcagtgaagctcatccacgaagtccagaattctgcctggaaaccagcttcctcctcagctccagctcttttaatgggcatatcaaaactgatgactttttccttcctgctacatgggtaacacttagttgtttgtctaatttctattttccagaaatttctcaaaatgtctgctgatagcccctcactcatatttttcatgtgggtttatagctttcatatttctttattattgtaaatgggggctgtggaaggtgagaaaacacatgctttcttaaaacagaagctctctccttcattaatttaaatatttttatcggctctagaaaatgcataaggttagtacaagatcagtagagagaaagtcaaagattacagaagtgctgaagcagaccattcttcctttcttcccaatgtctattaagatcacacataggtaaactgttacaaatccagaatggtgaaagagtccaacaatggctgagggaagtagaggttaagatatagctcaacagtgaaagtagcagggaaagagctgggcaaggccaagaccatcttttgtaccgttggtacagtaggctaaaggtacggtgttccatattaaatacagcaatatgaagaaaaataaattaagtcccttatacctaa

SEQ ID NO: 116556 - DNA, 3290 bp, Homo sapiens
  Payload ID: 2736
  Gene Symbol: CEP44
  Gene Name: centrosomal protein 44kDa
  Uniprot ID: Q9C0F1
  ENST ID: ENST00000457424
  CDS Start-End: 306-1505
ggagcacagagaagctcccagctttgaaggtcttgcggtggtgcgtggcgggcaggaacccacaattccaaatacaaacggtcggcgcgagaagcgcttctgggcgcaggcgcctggctgtagcgactggttgcgggaggctggactctggtgactgtaagcatcaagtgtacctgatttgtgaacctatcttgcttcagttggtttcctcctaaatattaggcagatgggattggctggtctgtgctctgctaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaagaatgatgaatttatagagtttaatgaagttagtgaagactacgcttcttgtagtgacatggaccttctgaatcctcacagaaaaagcgaagtagagaggccagcaagtattcctctgtcctctggctatagtacagcatcatcagattcaactcccagagcctctactgttaattactgtggtttgaatgagatttcagagaattttcctgcatggagtgctacatcctcttgttccagtctcagctggctgctccgtgggcatacttcatacctttcatcacagagctttgcttggcctctctcctgtgtgtaatctctgtttcttggatcctgtgcttaccttttcctgctgtactctgatgtttcagtgaagctcatccacgaagtccagaattctgcctggaaaccagcttcctcctcagctccagctcttttaatgggcatatcaaaactgatgactttttccttcctgctacatgggtaacacttagttgtttgtctaatttctattttccagaaatttctcaaaatgtctgctgatagcccctcactcatatttttcatgtgggtttatagctttcatatttctttattattgtaaatgggggctgtggaaggtgagaaaacacatgctttcttaaaacagaagctctctccttcattaatttaaatatttttatcggctctagaaaatgcataaggttagtacaagatcagtagagagaaagtcaaagattacagaagtgctgaagcagaccattcttcctttcttcccaatgtctattaagatcacacataggtaaactgttacaaatccagaatggtgaaagagtccaacaatggctgagggaagtagaggttaagatatagctcaacagtgaaagtagcagggaaagagctgggcaaggccaagaccatcttttgtaccgttggtacagtaggctaaaggtacggtgttccatattaaatacagcaatatgaagaaaaataaattaagtcccttatacctaagacctctatttctctgttgattacatacacagtggcaatggaaagaagggaaaataatggggatagcatttgctcattctctgaccatgcaacactggcagcattctatacttattctattaactgcatcaaccacatcttataaaacacatttccataggccatatgtaataggccttggctttattcattgcatttattggctccttaaattgacaacatataattgttttcatataattttcatcaaataaaattcactttaatttgtatgaacatatttaaagtggaaagtatcttcccaaatggtccatatcttaaagtgtcagatattttatgggcttcacatctgaactgccagagatctcaggcatagcatgcattaatcacaaccacttactgacctggttcagatacttactcaatacatggggctagacacagagtgtgccttaggctaaagaaaaaattattcaagttgagcatatccataaactctggctcaagcagtgtattttgggggtaataaacacaagtttgttcctagttggagggatatgatgcttaggtttgaacctgttaaccttcctgggtttgagggctagaaaacgtggagacattcctttctaactaacacattttctaatagaaacaatccaccaggatgttgagcccacattttaagagttcttcggaatttactgaaaatggaaaactgattacattgggcacataggacatttatatttatagaaacattttagataagacaagaattttaaaagccagaaatcacttttagtgggcattttcagaaaaatgttgtcaactttttgtaatttttaataggcataaaaaagattgttatattgatattgacagaaattaggtggttaattagagagcgtaaaaggatgaattgctctaacattggtttagaatttttctttatatgattcaattttgtggtctggcaaaggcccaatagtcatttatctagtatgcatacctttccacagctggattttcaaatatgatgataaagttcatatgacagacctattctgaaaataaatatgtcagcagg

SEQ ID NO: 116557 - DNA, 3037 bp, Homo sapiens
  Payload ID: 2736
  Gene Symbol: CEP44
  Gene Name: centrosomal protein 44kDa
  Uniprot ID: Q9C0F1
  ENST ID: ENST00000426172
  CDS Start-End: 53-1252
aggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaagaatgatgaatttatagagtttaatgaagttagtgaagactacgcttcttgtagtgacatggaccttctgaatcctcacagaaaaagcgaagtagagaggccagcaagtattcctctgtcctctggctatagtacagcatcatcagattcaactcccagagcctctactgttaattactgtggtttgaatgagatttcagagaattttcctgcatggagtgctacatcctcttgttccagtctcagctggctgctccgtgggcatacttcatacctttcatcacagagctttgcttggcctctctcctgtgtgtaatctctgtttcttggatcctgtgcttaccttttcctgctgtactctgatgtttcagtgaagctcatccacgaagtccagaattctgcctggaaaccagcttcctcctcagctccagctcttttaatgggcatatcaaaactgatgactttttccttcctgctacatgggtaacacttagttgtttgtctaatttctattttccagaaatttctcaaaatgtctgctgatagcccctcactcatatttttcatgtgggtttatagctttcatatttctttattattgtaaatgggggctgtggaaggtgagaaaacacatgctttcttaaaacagaagctctctccttcattaatttaaatatttttatcggctctagaaaatgcataaggttagtacaagatcagtagagagaaagtcaaagattacagaagtgctgaagcagaccattcttcctttcttcccaatgtctattaagatcacacataggtaaactgttacaaatccagaatggtgaaagagtccaacaatggctgagggaagtagaggttaagatatagctcaacagtgaaagtagcagggaaagagctgggcaaggccaagaccatcttttgtaccgttggtacagtaggctaaaggtacggtgttccatattaaatacagcaatatgaagaaaaataaattaagtcccttatacctaagacctctatttctctgttgattacatacacagtggcaatggaaagaagggaaaataatggggatagcatttgctcattctctgaccatgcaacactggcagcattctatacttattctattaactgcatcaaccacatcttataaaacacatttccataggccatatgtaataggccttggctttattcattgcatttattggctccttaaattgacaacatataattgttttcatataattttcatcaaataaaattcactttaatttgtatgaacatatttaaagtggaaagtatcttcccaaatggtccatatcttaaagtgtcagatattttatgggcttcacatctgaactgccagagatctcaggcatagcatgcattaatcacaaccacttactgacctggttcagatacttactcaatacatggggctagacacagagtgtgccttaggctaaagaaaaaattattcaagttgagcatatccataaactctggctcaagcagtgtattttgggggtaataaacacaagtttgttcctagttggagggatatgatgcttaggtttgaacctgttaaccttcctgggtttgagggctagaaaacgtggagacattcctttctaactaacacattttctaatagaaacaatccaccaggatgttgagcccacattttaagagttcttcggaatttactgaaaatggaaaactgattacattgggcacataggacatttatatttatagaaacattttagataagacaagaattttaaaagccagaaatcacttttagtgggcattttcagaaaaatgttgtcaactttttgtaatttttaataggcataaaaaagattgttatattgatattgacagaaattaggtggttaattagagagcgtaaaaggatgaattgctctaacattggtttagaatttttctttatatgattcaattttgtggtctggcaaaggcccaatagtcatttatctagtatgcatacctttccacagctggattttcaaatatgatgataaagttcatatgacagacctattctgaaaataaatatgtcagcagg

SEQ ID NO: 116558 - DNA, 913 bp, Homo sapiens
  Payload ID: 2736
  Gene Symbol: CEP44
  Gene Name: centrosomal protein 44kDa
  ENST ID: ENST00000515299
  CDS Start-End: 320-913
ttccaaatacaaacggtcggcgcgagaagcgcttctgggcgcaggcgcctggctgtagcgactggttgcgggaggctggactctggtgactgtgtatggttgcatatgctccgttttcctctccctgtcgtgctgggcctttgaaaccggcttctttgctggtggctgcttgaagcatcaagtgtacctgatttgtgaacctatcttgcttcagttggtttcctcctaaatattaggcagatgggattggctggtctgtgctctgctaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaat

SEQ ID NO: 116559 - DNA, 4534 bp, Homo sapiens
  Payload ID: 2736
  Gene Symbol: CEP44
  Gene Name: centrosomal protein 44kDa
  Uniprot ID: Q9C0F1
  ENST ID: ENST00000503780
  CDS Start-End: 415-1587
gacgttaggctccgactcttaacggagacgcatttttatttctgttgtttacgattcgctatagattccttgtttctcacttcgtagcacgagccactctgaccatcaagatcagaaaaacttctcagctgcaagttagaagtggactggccattgaggaggctctcagcggagtcgctcttcacaggagtcttgaacgcggtgtggaatcggcagcgaggaatcctggagcacagagaagctcccagctttgaaggtcttgcggtgaagcatcaagtgtacctgatttgtgaacctatcttgcttcagttggtttcctcctaaatattaggcagatgggattggctggtctgtgctctgctaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaagaatgatgaatttatagagtttaatgaagttagtgaagactacgcttcttgtagtgacatggaccttctgaatcctcacagaaaaagcgaagtagagaggccagcaagtattcctctgtcctctggctatagtacagcatcatcagattcaactcccagagcctctactgttaattactgtggtttgaatgagatttcagaggaaacaacaatccagaaaatggaaaggatgaaaaaaatgtttgaagaaactgcagagttactgaaatgtccaaatcactacttgtaggattttctacatgaacttttttctaggactttggttactatacatattgtatattttaagaattctttatacaattttaatatactgcaatactgcagtttttgacaatttggattccatttggtatatgaatttttgcattcattattgaataactcttttaatatttttgagcaatgattatactgctttaccttgtgtcactttttttttttttaggaaaaactcatgttccagtatatttctcttacagagtgaagtcattacagcactgtatttctgtgttgacatttgttggcagtgtgctaagtaatgttttttaaagcacaggcttgaggactatggtttacatcctgttggaaacattccaaatgggacttgtgtattatacccaggaggctctcatatataccatcttggcatctgtactgatgaataagttataatgaacagttaaaaatgctcattgaaaattaaataaaacaaaaaggcagttatttcatgcttggtcaaaaacatcaatacctttccaattaacactgagaaattaaggttaagattctccttttgtactgggaaacaggctggaggactatggtcctcaagtttagaccaagaggactatggtctcaaggttcaccatgagaaatgtgttgaacattttagtatgctctattgtataatttttttggagggggggatggagtttcgctgttgttgcccaggctggagtgcaatagcacgatcttggctcaccgcaacctctgcctaccgggttcaagtgattcttgtgcctcagcctcctgagtagctgggattataggcatgcaccaccatgcccagctaattttgtatttttattagagacagggtttctccgtgttggtcaggctggtctcaaactcctgacctcaggtgatctgcctgtcttggcctccggcgtaacactttttaagaccagtgtaacagaaagagaatgtagccattctagccaccgttaaaagatacacagtgaggtgttgtgttttgtttttttaatgatgaaaagttacacattttttggagagaaaagtcttagctgaaggtaaatcaatggaaaaatgaaatttatttttaatattactactatatgaattatctttttttaaacttgtagataaaagtgttccagtaatcagaaaatcctcaagaaaattgacttcattatttggaaggaaaattagtattttttttaatattatatggaccatctgattatattttatttattcatctatttatggtatgtatgtataattctatattacactgtcaaatataaaatattgttatatgagtagaaatcacttaaattttttttgtgtttgtgaatttgaaacagtgtaagaaatcacttttaagaaaacatttttagaattcctttgttttttttttttttctttttgaaacagggtctcactctattgcccaggctggagtgcactggcgtgatctcggctcactgcaccttctgcctaccgagttcaagcgattcttgtgcttcagcctcctgagtagctgggactataggcctgtaccgtcatgcctggctaatttttgtatttttgtagagacagggtttcaccatgttgcccagtctgttctcaaactcgtgagctaaagctactcgcccacctggatgtcccaaagtgctagattccatgggtgagtcaccatgcttggccacatttttagtattctaataaacagttggtcatcagaactttaaaatggtagcctacagaaacatacaattttgaatttaacagagtttcagtaaatatttccagaattaatgaagcatgttagctttaattttttcaattgtgagagaagtacatttataaaaattaagaggttaagaggttatagttataagggaaaaaacttctgtatcgattaactcctaaaatatcagtaccagcatggaattatagcaccaccttgtggttaacatgccagtattttaccttttgttaaaacaagtgatttcccatcaaacaggataatattttttcccttttgaaaaattcaattttaaaaagaaacatttttgaagttttcttatggaagatagaaaaaaagttaagtctctttctaccctttctttttttctttatatagtgcagatatacacacagagaagggacttaaaacatttctaatctcctagtttatatacagtgtgcaaaatataagtaagtatatattgaaaatataaaatatttcatatatgttatcaggtggaaatttagaatccaaattttcttaaactttaataacttgtctaacaactctctaatagggactaaaaatcaactcaatatatcatacatttacacttacaaagagtctttatctagacaacataatttttggaaaaataaagcaaattcaactttattggagttattggacagatcagcaaattgttattttaaaaagttttcttgtttaggcaatttggtaagtggtttctagttataaactagccactgttgattaacttgagaaggtgaagcaggggagttctgaagagattacctagagctacataaccctaagttaagtaaaattttcactttcattcttttcattctctcataaactggttgaaaaaacactgtactaccaacaaaggtgtcagttgcttgtgctgccctgtctatgttatgctctgaataggtctcggtaaagattatatggaaatactataaagaatacataaggtaaaatactagtcagaaagggttcagaagaagttagcatcaactgtatgaaaattctaggtaaagctaagtactattgagttggaaaaaagtaattctatcatgtttgcttgttttcctctactgtttttaatgtgatgttgtaatatattttaaaaataaaacttgaaaacgttggg

SEQ ID NO: 116560 - DNA, 732 bp, Homo sapiens
  Payload ID: 2736
  Gene Symbol: CEP44
  Gene Name: centrosomal protein 44kDa
  ENST ID: ENST00000503053
  CDS Start-End: 315-732
tggctgtagcgactggttgcgggaggctggactctggtgactgtgtatggttgcatatgctccgttttcctctccctgtcgtgctgggcctttgaaaccggcttctttgctggtggctgcttgctctgcttgtattactcttcaaaatatttattcactggtactgaagagagacataactttgttgtcagaaattccattatcagaggtagaaatcatgtaagagacactgaaatgttttccaaaatgtcagaaaaaggaaaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctg

SEQ ID NO: 116561 - DNA, 605 bp, Homo sapiens
  Payload ID: 2736
  Gene Symbol: CEP44
  Gene Name: centrosomal protein 44kDa
  ENST ID: ENST00000514712
  CDS Start-End: 269-605
agctttgaaggtcttgcggtggtgcgtggcgggcaggaacccacaattccaaatacaaacggtcggcgcgagaagcgcttctgggcgcaggcgcctggctgtagcgactggttgcgggaggctggactctggtgactgtgtatggttgcatatgctccgttttcctctccctgtcgtgctgggcctttgaaaccggcttctttgctggtggctgcttggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattt

SEQ ID NO: 116562 - DNA, 600 bp, Homo sapiens
  Payload ID: 2736
  Gene Symbol: CEP44
  Gene Name: centrosomal protein 44kDa
  ENST ID: ENST00000505124
  CDS Start-End: 265-600
attcgctatagattccttgtttctcacttcgtagcacgagccactctgaccatcaagatcagaaaaacttctcagctgcaagttagaagtggactggccattgaggaggctctcagcggagtcgctcttcacaggagtcttgaacgcggtgtggaatcggcagcgaggaatcctggagcacagagaagctcccagctttgaaggtcttgcggtggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatatt

SEQ ID NO: 116563 - DNA, 2638 bp, Homo sapiens
  Payload ID: 2737
  Gene Symbol: CEP55
  Gene Name: centrosomal protein 55kDa
  Uniprot ID: Q53EZ4
  ENST ID: ENST00000371485
  CDS Start-End: 305-1699
cacacctgatggtgtgactcggccgacgcgagcgccgcgcttcgcttcagctgctagctggcccaagggaggcgaccgcggagggtggcgaggggcggccaggacccgcagccccggggccgggccggtccggaccgccagggagggcaggtcagtgggcagatcgcgtccgcgggattcaatctctgcccgctctgataacagtccttttccctggcgctcacttcgtgcctggcacccggctgggcgcctcaagaccgttgtctcttcgatcgcttctttggacttggcgaccatttcagagatgtcttccagaagtaccaaagatttaattaaaagtaagtggggatcgaagcctagtaactccaaatccgaaactacattagaaaaattaaagggagaaattgcacacttaaagacatcagtggatgaaatcacaagtgggaaaggaaagctgactgataaagagagacacagacttttggagaaaattcgagtccttgaggctgagaaggagaagaatgcttatcaactcacagagaaggacaaagaaatacagcgactgagagaccaactgaaggccagatatagtactaccacattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtttctttacacatctctgctaaagcagcaagaagaacaaacaagggtagctctgttggaacaacagatgcaggcatgtactttagactttgaaaatgaaaaactcgaccgtcaacatgtgcagcatcaattgcatgtaattcttaaggagctccgaaaagcaagaaatcaaataacacagttggaatccttgaaacagcttcatgagtttgccatcacagagccattagtcactttccaaggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagactactaacattttgcactgtcaaaatacttggtgaggaaaagatagctcaggttattgctaatgggttaatgcaccagcaagcaaaatattttatgttttgggggttttgaaaaatcaaagataattaaccaaggatcttaactgtgttcgcattttttatccaagcacttagaaaacctacaatcctaattttgatgtccattgttaagaggtggtgatagatactattttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgttttaa

SEQ ID NO: 116564 - DNA, 747 bp, Homo sapiens
  Payload ID: 2737
  Gene Symbol: CEP55
  Gene Name: centrosomal protein 55kDa
  ENST ID: ENST00000445435
  CDS Start-End: 1-626
actcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtttctttacacatctctgctaaagcagcaagaagaacaaacaagggtagctctgttggaacaacaggtactcattcgggttgcttctaaattcaattctgcctgttagaaaatgcagtttttcctcatgtttatgctgttctatggagaactgtttgaaagttgtgaaaagtgtctttaaaagacttcaataaaagtctttcttcttcaataaaaaagatatttcaaga

SEQ ID NO: 116565 - DNA, 3098 bp, Homo sapiens
  Payload ID: 2738
  Gene Symbol: CEP57
  Gene Name: centrosomal protein 57kDa
  Uniprot ID: Q86XR8
  ENST ID: ENST00000325486
  CDS Start-End: 239-1663
gattggctaggaaagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatataaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatttg

SEQ ID NO: 116566 - DNA, 3178 bp, Homo sapiens
  Payload ID: 2738
  Gene Symbol: CEP57
  Gene Name: centrosomal protein 57kDa
  Uniprot ID: Q86XR8
  ENST ID: ENST00000325542
  CDS Start-End: 239-1741
gattggctaggaaagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatataaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatttgaa

SEQ ID NO: 116567 - DNA, 1739 bp, Homo sapiens
  Payload ID: 2738
  Gene Symbol: CEP57
  Gene Name: centrosomal protein 57kDa
  ENST ID: ENST00000539855
  CDS Start-End: 184-432
agcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagcatccacgtttgtgtttgtatttggcagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttat

SEQ ID NO: 116568 - DNA, 851 bp, Homo sapiens
  Payload ID: 2738
  Gene Symbol: CEP57
  Gene Name: centrosomal protein 57kDa
  ENST ID: ENST00000544522
  CDS Start-End: 258-851
gtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgtgtgcagactagggaaatgaagtacaatgttgaccagaattgataacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaa

SEQ ID NO: 116569 - DNA, 760 bp, Homo sapiens
  Payload ID: 2738
  Gene Symbol: CEP57
  Gene Name: centrosomal protein 57kDa
  ENST ID: ENST00000535224
  CDS Start-End: 1-760
acttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagat

SEQ ID NO: 116570 - DNA, 1936 bp, Homo sapiens
  Payload ID: 2738
  Gene Symbol: CEP57
  Gene Name: centrosomal protein 57kDa
  ENST ID: ENST00000540830
  CDS Start-End: 167-382
gggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttt

SEQ ID NO: 116571 - DNA, 1647 bp, Homo sapiens
  Payload ID: 2738
  Gene Symbol: CEP57
  Gene Name: centrosomal protein 57kDa
  ENST ID: ENST00000537677
  CDS Start-End: 215-1636
aaaggtctgcggtcgcggctatttctaacagccagtcccaggtttggctgagagcgccccaatccaattgagcaaatgttcgcgaaaggctcgttctctgccgcaactttttttcccttgctttctattggactaaatcgttaagtccctcctaatcctatttgttattggccaaaagaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccag

SEQ ID NO: 116572 - DNA, 446 bp, Homo sapiens
  Payload ID: 2738
  Gene Symbol: CEP57
  Gene Name: centrosomal protein 57kDa
  ENST ID: ENST00000535497
  CDS Start-End: 169-294
gagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaa

SEQ ID NO: 116573 - DNA, 2911 bp, Homo sapiens
  Payload ID: 2738
  Gene Symbol: CEP57
  Gene Name: centrosomal protein 57kDa
  Uniprot ID: Q86XR8
  ENST ID: ENST00000541150
  CDS Start-End: 1-1476
atgttgaccagaattgataacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatataaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatttg

SEQ ID NO: 116574 - DNA, 590 bp, Homo sapiens
  Payload ID: 2738
  Gene Symbol: CEP57
  Gene Name: centrosomal protein 57kDa
  ENST ID: ENST00000538095
  CDS Start-End: 202-360
ctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaccagaggctgggctctggattacagctcagtagtgggtcatggaatatgtactgtgactcaacccgtatcattttcaagaaagaagagagagaaaatcgttcagcaaatataactgaatgaattatctggttcacagaaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttgg

SEQ ID NO: 116575 - DNA, 404 bp, Homo sapiens
  Payload ID: 2738
  Gene Symbol: CEP57
  Gene Name: centrosomal protein 57kDa
  ENST ID: ENST00000537093
  CDS Start-End: 1-404
acacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctt

SEQ ID NO: 116576 - DNA, 2084 bp, Homo sapiens
  Payload ID: 2738
  Gene Symbol: CEP57
  Gene Name: centrosomal protein 57kDa
  Uniprot ID: Q86XR8
  ENST ID: ENST00000538658
  CDS Start-End: 41-853
ccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaaggtgtgaagacagaaccaaatcaggcaaaatgctgattacttggtatagtttatgtcaaaacacccataaactgtgtggtgtactacaaccttgagagagtaaatctttcattctcaatttcttcattcagaaggtggagataagtaatacctactcctaaatttttatcctgatagtgagaaaatatataagcattttggaactacagaacaccatacaaaattagcattattagtactgcattatcttgtgctcttacaatgttttgtgtatatgtatactgattttctacttagaatgtaactgttgttttgtcaagtgcttttttccccccagcctttcctaggctaggatatatgctaacaagtactattaggagctggcttgtgatcataatgccaactatagataaggcaagtagtagcctagtagttaactgaagtttcaagttagtcatgtatagtcagtttttattatcatgtgaataaaataaaattgttttccttttcttttcattcagaaaagttctaggaactattttggtgcacaaccacattatagattatgcttgggtgatatgccatttgtagctgggaaggtgagttggtcaaactccggattctttttatacaacattgatccctgaattaagtccctgcatctgcaagtatgtctacaaatggaaggaacatttttctgtgcctttaccagtgtgtggatcacagtgatgtgaaaatgagatgtagggaggtttttggggattagggaagcaaggaagagatggggaggataccttaaagtagataaagtatatgtggaaaggaagtgataaaacagagaccctaagttgaagaaggtgttgtttcagataggggtcaaggaaataagaaatagtatgtttgtagcattggatttttagtatcaatcctgttgagttacatttagatataggtagatattcgaataagcacgtagcacattctgcttgtcctcacatccagatcatttctaggactaattctccaagaagcagtcatacgtacacttgaatcttcagtttcttcagcacttgaatgtaaagctgtattgtcatatatcaagtactgagtgaagtgcctaaaactgtgctagttgacactactttataagctgtttgtgttgctggtggttttatatttagattccaactagattgttattctggcatcttgggaagtaaatgttcttctgaattttg

SEQ ID NO: 116577 - DNA, 870 bp, Homo sapiens
  Payload ID: 2738
  Gene Symbol: CEP57
  Gene Name: centrosomal protein 57kDa
  ENST ID: ENST00000541365
  CDS Start-End: 254-870
ggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctga

SEQ ID NO: 116578 - DNA, 2515 bp, Homo sapiens
  Payload ID: 2739
  Gene Symbol: CEP57L1
  Gene Name: centrosomal protein 57kDa-like 1
  Uniprot ID: Q8IYX8
  ENST ID: ENST00000359793
  CDS Start-End: 193-1575
aaaatggatcctcacttcttcacttggatataataatatagactgccgacattctgggaactgatcagtcttccagcttccagtgtggtgccctccctcaattgtgctgagtgtcccccaatccagagatattctgtaatttcttcctcagaaagaaacaaaacaaaattctgatcttcccagatgaagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgg

SEQ ID NO: 116579 - DNA, 1649 bp, Homo sapiens
  Payload ID: 2739
  Gene Symbol: CEP57L1
  Gene Name: centrosomal protein 57kDa-like 1
  Uniprot ID: Q8IYX8
  ENST ID: ENST00000368968
  CDS Start-End: 60-1235
ggtgcccgcgaaccaacggttagcggtggcaggggctgactgagagcgtctgcttgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtaagaaggctttagtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgctttttt

SEQ ID NO: 116580 - DNA, 1680 bp, Homo sapiens
  Payload ID: 2739
  Gene Symbol: CEP57L1
  Gene Name: centrosomal protein 57kDa-like 1
  ENST ID: ENST00000368970
  CDS Start-End: 51-1484
gaaccaacggttagcggtggcaggggctgactgagagcgtctgcttgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagtctaccagtgcaagctgttctgtgaatgcaagtatgcaaaactttttgcagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatt

SEQ ID NO: 116581 - DNA, 1947 bp, Homo sapiens
  Payload ID: 2739
  Gene Symbol: CEP57L1
  Gene Name: centrosomal protein 57kDa-like 1
  ENST ID: ENST00000407272
  CDS Start-End: 422-1177
gggccaagcgcccccggaggcgctaagcttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaaggtgtgcatataaaattttttcccaaacaaaaatactgctaatacttattcaggttaaaaaaagtagcagcagtcatgtacaaaatttagctctgagtttgcttgacaaccaaagcaaaaaggaacatataatggacagtatagctatctttgtgaaataacaggaagcactccagtttttctagaaagattaacatttttctagttttaaacttctggagaaacatattttgtgatagtttataaaagaggcagtaaacaacacagtagatactgacaacataataaatcctgaaagcagttttatgtaatatatagacaataaaaaataaggtttttcttatagacctgttaagtctgtaaagtcatttatatagggaatttattgttatatgtaatttctatgcttatttcttgtgaatttgcccaaaagtaaggattggagagttagtactttatagaccaatattttgtttagatggattgatgttttgaatgtatgctattcaagtaacccttcttaattatatataatggtatgaaaaaagtttttaatcccttttaatcttatgattgtggaattatggttttgatggccattattactatttattcagatatgaatggagtgagtgttctctgtgccatttgttgtgggggacaggagatgctatttgggaattctggccactgccatatgcttagcttgtggataaaataatggagagaacagtaaacttaactttggctactcttttattacgtaaataaaaattaatgttc

SEQ ID NO: 116582 - DNA, 819 bp, Homo sapiens
  Payload ID: 2739
  Gene Symbol: CEP57L1
  Gene Name: centrosomal protein 57kDa-like 1
  ENST ID: ENST00000524064
  CDS Start-End: 235-819
ggggccaccgcgacgttgcctgtgggtgcccgcgaaccaacggttagcggtggcaggggctgactgagagcgtctgcttgtgcctggtacctagtacaaacttaataaatgtgtgacgcaagaataaaggaatgaatgaatggaagaatgatataatgccacagaactttcaaagatgggactgtctagttgcaaaaacaagctcagggatcccactgattctactttacgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaag

SEQ ID NO: 116583 - DNA, 2771 bp, Homo sapiens
  Payload ID: 2739
  Gene Symbol: CEP57L1
  Gene Name: centrosomal protein 57kDa-like 1
  Uniprot ID: Q8IYX8
  ENST ID: ENST00000517392
  CDS Start-End: 427-1809
gaactgggccaagcgcccccggaggcgctaagcttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctggaagcctatgggaactagtacaa

SEQ ID NO: 116584 - DNA, 2259 bp, Homo sapiens
  Payload ID: 2739
  Gene Symbol: CEP57L1
  Gene Name: centrosomal protein 57kDa-like 1
  ENST ID: ENST00000521522
  CDS Start-End: 99-1322
aaactacaacccccaggggccaccgcgacgttgcctgtgggtgcccgcgaaccaacggttagcggtggcaggggctgactgagagcgtctgcttgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagaaaactaaatgtataaagagacgaccaccttggcaaatttgttcaaagtttggagcactgccttttgtggctgaaaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttc

SEQ ID NO: 116585 - DNA, 769 bp, Homo sapiens
  Payload ID: 2739
  Gene Symbol: CEP57L1
  Gene Name: centrosomal protein 57kDa-like 1
  ENST ID: ENST00000522608
  CDS Start-End: 431-769
gcgacgttgcctgtgggtgcccgcgaaccaacggttagcggtggcaggggctgactgagagcgtctgcttgattcaggttatgctttctggccagaatactgcataggtgatgttgcgtccttctccaggtttcatatccagaggcacatggtggccttctacctctcacagacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaa

SEQ ID NO: 116586 - DNA, 1120 bp, Homo sapiens
  Payload ID: 2739
  Gene Symbol: CEP57L1
  Gene Name: centrosomal protein 57kDa-like 1
  ENST ID: ENST00000520610
  CDS Start-End: 312-701
gggtgcccgcgaaccaacggttagcggtggcaggggctgactgagagcgtctgcttgctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaaggataaatgcgtaagagaacaattgttgggtcatgtgataagtacatttttagttttataagaaactgccaaactgtcttccaaaatggctgtaccattttgtattcccaccaacaatataaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactc

SEQ ID NO: 116587 - DNA, 553 bp, Homo sapiens
  Payload ID: 2739
  Gene Symbol: CEP57L1
  Gene Name: centrosomal protein 57kDa-like 1
  ENST ID: ENST00000523174
  CDS Start-End: 1-519
cttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtaagaaggctttagtaagagattttaataaaaacacaaaatatctgga

SEQ ID NO: 116588 - DNA, 575 bp, Homo sapiens
  Payload ID: 2739
  Gene Symbol: CEP57L1
  Gene Name: centrosomal protein 57kDa-like 1
  ENST ID: ENST00000522461
  CDS Start-End: 490-575
cttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgtgcctggtacctagtacaaacttaataaatgtgtgacgcaagaataaaggaatgaatgaatggaagaatgatataatgccacagaactttcaaagataatggattctgaattaatgcatagtatagtaggaagctatcataaacctccagaaagagtatttgttccctcattcacccagaatga

SEQ ID NO: 116589 - DNA, 965 bp, Homo sapiens
  Payload ID: 2739
  Gene Symbol: CEP57L1
  Gene Name: centrosomal protein 57kDa-like 1
  ENST ID: ENST00000519286
  CDS Start-End: 348-965
aagcgcccccggaggcgctaagcttgcgccctgaggcggtttccgttcccggacgtttggactctgtcctggagaaggggaaggaaaaaacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaa

SEQ ID NO: 116590 - DNA, 861 bp, Homo sapiens
  Payload ID: 2739
  Gene Symbol: CEP57L1
  Gene Name: centrosomal protein 57kDa-like 1
  ENST ID: ENST00000522490
  CDS Start-End: 363-861
cccgcgaaccaacggttagcggtggcaggggctgactgagagcgtctgcttgatgggactgtctagttgcaaaaacaagctcagggatcccactgattctactttacgctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaaggtgagaggggataaaatgaagatagtcgttcaaaaaaactcctgttttgttatgaggcaacatcgtgacccacatatccttcagaaacctt

SEQ ID NO: 116591 - DNA, 2055 bp, Homo sapiens
  Payload ID: 2739
  Gene Symbol: CEP57L1
  Gene Name: centrosomal protein 57kDa-like 1
  ENST ID: ENST00000520883
  CDS Start-End: 36-1118
ggtggcaggggctgactgagagcgtctgcttgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttc

SEQ ID NO: 116592 - DNA, 866 bp, Homo sapiens
  Payload ID: 2739
  Gene Symbol: CEP57L1
  Gene Name: centrosomal protein 57kDa-like 1
  ENST ID: ENST00000523209
  CDS Start-End: 560-866
cgcgaaccaacggttagcggtggcaggggctgactgagagcgtctgcttgacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactcca

SEQ ID NO: 116593 - DNA, 813 bp, Homo sapiens
  Payload ID: 2739
  Gene Symbol: CEP57L1
  Gene Name: centrosomal protein 57kDa-like 1
  ENST ID: ENST00000518853
  CDS Start-End: 124-813
gcgccctgaggcggtttccgttcccggacgtttggactctgtcctggagaaggggaaggaaaaaatgggactgtctagttgcaaaaacaagctcagggatcccactgattctactttacgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattata

SEQ ID NO: 116594 - DNA, 812 bp, Homo sapiens
  Payload ID: 2739
  Gene Symbol: CEP57L1
  Gene Name: centrosomal protein 57kDa-like 1
  ENST ID: ENST00000518329
  CDS Start-End: 653-812
aagcttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaag

SEQ ID NO: 116595 - DNA, 2522 bp, Homo sapiens
  Payload ID: 2739
  Gene Symbol: CEP57L1
  Gene Name: centrosomal protein 57kDa-like 1
  ENST ID: ENST00000523787
  CDS Start-End: 198-1589
agagcgtctgcttgaaaatggatcctcacttcttcacttggatataataatatagactgccgacattctgggaactgatcagtcttccagcttccagtgtggtgccctccctcaattgtgctgagtgtcccccaatccagagatattctgtaatttcttcctcagaaagaaacaaaacaaaattctgatcttcccagatgaagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatt

SEQ ID NO: 116596 - DNA, 3832 bp, Homo sapiens
  Payload ID: 2739
  Gene Symbol: CEP57L1
  Gene Name: centrosomal protein 57kDa-like 1
  ENST ID: ENST00000521277
  CDS Start-End: 526-1233
cgcggctgccagccactgccggctgctacgcatgcgtgactgcgaactgggccaagcgcccccggaggcgctaagcttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgatgggactgtctagttgcaaaaacaagctcagggatcccactgattctactttacgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaaggtgtgcatataaaattttttcccaaacaaaaatactgctaatacttatttatataacctcttaatccttatacctacccctttccaaaaaggatttgaagatataaaataaaagacatgcaataatgcgtgtcaagtaatggatgatggtttggggtataaggacagaaaatttcataagattcaggttaaaaaaagtagcagcagtcatgtacaaaatttagctctgagtttgcttgacaaccaaagcaaaaaggaacatataatggacagtatagctatctttgtgaaataacaggaagcactccagtttttctagaaagattaacatttttctagttttaaacttctggagaaacatattttgtgatagtttataaaagaggcagtaaacaacacagtagatactgacaacataataaatcctgaaagcagttttatgtaatatatagacaataaaaaataaggtttttcttatagacctgttaagtctgtaaagtcatttatatagggaatttattgttatatgtaatttctatgcttatttcttgtgaatttgcccaaaagtaaggattggagagttagtactttatagaccaatattttgtttagatggattgatgttttgaatgtatgctattcaagtaacccttcttaattatatataatggtatgaaaaaagtttttaatcccttttaatcttatgattgtggaattatggttttgatggccattattactatttattcagatatgaatggagtgagtgttctctgtgccatttgttgtgggggacaggagatgctatttgggaattctggccactgccatatgcttagcttgtggataaaataatggagagaacagtaaacttaactttggctactcttttattacgtaaataaaaattaatgttcaatacttgggctgtatttttcataattttttcattttaaagaattttcaaactacaataacgaacaatatttccccaatatgacttattttggctctttcctttcctaaatatttgttttgtgtcttatttgtgcaatgagattcacagctacaaagccaaatagaaaaatcactataagtaatttgccagtggaacacatactgcccagtatgtatgttttatggcatcctttctctgatgggttaatggaacttttttcagtttacctatttattataaaaatagtgaaggtacagggagaagataaaagaaatgaaggaaagaaaaggtaactactggaagagaagagagtaattaacagcagaatcattttatggaagtacttagttcaaatcccaagttcacggggtatgcaaataatgatgtctctttttaaagatggagggagtgctaaagttgctgaaagtaggatcagatttcaagaagcctctatgagagatctgcttcccatcacactgtttctccatgtcctggacatagttcattcaactcttacatcttgatgtacatagactggtatctctaggtgataaaaagataagacaggaatttgtgagaaacagataaatatataagtataaaacagtataatagaagattaatagaggtttaaacaaagtgttgtggtgctgtgtagacaaaggaatatgtgaaaggtaattcaagagcaatattaaaggaagccttgaagaattaaatattgacagactgagatgaggaaaaatgtgttatagtctgagggaattgttggtttttccagggacctataagtaatagtccagtagtgggggtgagatgggatcataatgaaagttaaaatggaaaatatagcttggggtgagctaatggctgaccttgaatgccatgttaagagtttgaacttttattctataaacaggaactattgaaggcttctgagaagagtagggacatgattagagttgtaattttagatggtaactgacagcagtaggagagttttacaagagagaaatcagatgtgtagatttttgagagaatcatatgtgtagattcatgtcaccatcacaataatcaagatacagaactcttccaccactaaaaaactccttcatgcaatccctctatagctacacatccccttccctgaacattggcaacctctaatctgttcaccatctgtgtattttattatttcaagaatgttatataaatggaattatgcagtatgtaactttttgtggttggcttttttcccttgaggtccgtccaagttgtcgtatgtatcagtacatcctttttatttctgtgtggtattccgcattatggatgtaccacaatttaaccattcatctgttaaaggatatctggagccgggcgcggtggctcacacctgtaatcccaacagtttgggaggccaaggcgagtggatcatttgaggtcaggagttcaagaccagcctggccaatatggtgaaaccccatctgtactaaaaatacaaaaattagccaggcagtagtggcacacacctgtaatcccagctactcgggagacaaaagcaggagaatcgcttgagcctgggagacggaggttgcggtgagccaagatcataccactgcaccccagtctgggtgacagaatgagaccctatctc

SEQ ID NO: 116597 - DNA, 598 bp, Homo sapiens
  Payload ID: 2739
  Gene Symbol: CEP57L1
  Gene Name: centrosomal protein 57kDa-like 1
  ENST ID: ENST00000519407
  CDS Start-End: 362-598
gttgcctgtgggtgcccgcgaaccaacggttagcggtggcaggggctgactgagagcgtctgcttggttgggaaaccaattagaaaggagtgttctgctagaaacagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagct

SEQ ID NO: 116598 - DNA, 908 bp, Homo sapiens
  Payload ID: 2739
  Gene Symbol: CEP57L1
  Gene Name: centrosomal protein 57kDa-like 1
  ENST ID: ENST00000519095
  CDS Start-End: 68-823
tgcctgtgggtgcccgcgaaccaacggttagcggtggcaggggctgactgagagcgtctgcttgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaaggtgtgcatataaaattttttcccaaacaaaaatactgctaatacttatttatataacctcttaatccttatacctacccctttccaaaaaggatttg

SEQ ID NO: 116599 - DNA, 446 bp, Homo sapiens
  Payload ID: 2739
  Gene Symbol: CEP57L1
  Gene Name: centrosomal protein 57kDa-like 1
  ENST ID: ENST00000521503
  CDS Start-End: 111-446
gttgcctgtgggtgcccgcgaaccaacggttagcggtggcaggggctgactgagagcgtctgcttggttgggaaaccaattagaaaggagtgttctgctagaaacagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaa

SEQ ID NO: 116600 - DNA, 2056 bp, Homo sapiens
  Payload ID: 2740
  Gene Symbol: CEP63
  Gene Name: centrosomal protein 63kDa
  Uniprot ID: Q96MT8
  ENST ID: ENST00000332047
  CDS Start-End: 336-1823
caggatgtaccaaacgtggaagcggagacggggaggtctgggggtgccacgcaagtccctttcctcccgacacgagtgcagtaaagaaaaacggttatgagcgtaaagtgacagcctcggccgatgggaatagggggaagtccgacactgagcaacgaacgcattcccgcgcctccaaaacctaggccgggggcgctggaaacccttaccggcacccggccaccgcggcagacgcttgctcctgccacgccccccccccctcccccgcatcacgtgtctgcactcgctttcctcggattcccggatgtggttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcactatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagac

SEQ ID NO: 116601 - DNA, 5632 bp, Homo sapiens
  Payload ID: 2740
  Gene Symbol: CEP63
  Gene Name: centrosomal protein 63kDa
  Uniprot ID: Q96MT8
  ENST ID: ENST00000337090
  CDS Start-End: 28-2139
agttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataaggccacgggaagaatctctggcagaaaagaagtacacctctcaagggcagggggacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgaggcaaaagagatttcactagcagacctccaggagaattatattgaggcattaaataaattagtgtctgaaaatcaacaactacagaaagatttgatgaataccaaatctcagctggagatttctactcagatgtgcaaaaaacaaaatgacaggatctttaaaccaacacacagcagaacaactgagttcaagaatacagagttcaagccaacccatggccagcacagacatgatggaataaagactgagcactacaaaacagatcttcattctccaagaggacaagcgtcggatagtataaaccccatgtctagggtgctaagccccctgagtcctcaaatcagcccttgcagctccaccaggtctttgacttcctactctctatgtaaaactcattctttgccttcagcgctagatacaaatgaagccaatttttctgacactatgtctgagagtatgaatgaccaagaagagtttatatcttcgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcactatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagacttttttctcatacgaatatttattatcataaagtgatacttaccttgctgacttaaatgtgaatagctatgtactaattgaaataaggattttatgatacatgttgaaaataaagtaactgcaggaactttctttaggggaaatgtgtagaagcatggatttaggggtcaaacatacctggatcgatagactggttttgccacttaccagccaacggggcttgttatttactgggctggtagcccctcctagccaaggggctggtagtgtgtaaagtcaggctggtagtgaataaggggggggtgtgctaaagaaccttatcaagcagtcctctcttgctcaacactcatgcagaggagagaggcagggagggcaagggactggctgtcatgcacggtgcccatggaatatccattggaaataaatgttcatcgtctgcactgctgaggacaagtttagatgggagacaaagatctggatgttgatgtgccgcaggcatttgaaacgatgggagttgataagatccaccagggaggctgtggagagagagaggagcaggaggctgggtttggggccctgaaagatgccagcatctgaggatcacaggaaatagatctagcaaaggaactagaatgtgcagttacagatgagaaaggtcagtgtagtgtacttgccagctcaagggtgtggcctctgtgaaccctctttctgtagtggatctttcccatcagcgtaaaacatcctgttatttcccctttttaaataaaacctcagttttttttaatgcctctcttttactgctctgtatgtttgcttcccttcacccaaacacttctggaaagagttgtctgcagtgactctttccagttcctcaccccgccccaccgtagttctcttcctaaccctctccaacaccacttccatccccagactgctttcttgctcttgagttcaccagtgacctaatcagtgtctgagcatcattcagcacagttggactctctcttggcttctgtgacctggaacttctggtttcctctctacctcatcctccactccatctcatggcttttcctcttctaacctctaagtcagagggccccctagagctctgtcatgggttttctccctcagcattctcttccctagaagtttccattccattctcaagctcttaataccacctataggccagtgacccttacatttattactaatcttgacctctccccagagctgctgtcttagatacctagctgcttatgcgatgtcttcacttggatatctgacaaacatcttgtttccaagagagaactctttattctccctcttgctaagattccatatcaggacatagcattatgtttgccagttcctaggagttacttataattccttccttacccacatccgcatatccagtcatttgggaggtcctgtcatttcttcccccagaatcttatctcagacccaaccgtttccctcctgcacttctaccacctgatccagactacttctctctcaccctgattctggcagtagcctcctaactgatagtactcacaccagtaattcagggagcttctggagttatcctttagaaatgtaaatgaaacagtgtcaccactgcttcccttcagactcttccaaggcttctctttttttttttattgagacagagtctcactctgtcgcccaagctgcagtacagtggcaggatctcggctctctgcaacctccacctcccgggctcaagtgattctcctgccttagcttcccgagtagctgggattacaggcgcatgccaccaggcccagctaatttttgtatttttagtaggaacagggtttcaccatgttggtcaggctgatctcgaactcctgacctcaagtgatccacccgcctgagcttcccaaagtgctgggttataagcgtgagccactgcacccagccccaaggcttcttactgcactcagaataaaatccaaatgaattagtatagcctacagagtgtcaataatctgggcctaatcacccattgcatcatcctttactgtgctccacccatgctggcgtcctttctgtttattgagtgcagcaagctttaacctgttcgggtctttcatttgcagtttaccctgaatattccctttctcttacctcacctttgattggcgttttcccccttgcagacctgcactctggcatcctctcctgagcaagccttctttgattgctgcctcccaaacctgtttctccccatttctctagctcattggcctgtgttacttgcttcatagtgctcactactatctgaaatcatttcattacttgatttatgtttgtactgtctatttctgtctttagaattaaaactccttgagggcaaggactttgcttctctggttcatggtgggatcctcatcacccagcacaagcccaacacttaggagaggctcagctagtttgaaccaatggaaaatgccattcctgaggtgcaccacatcgtttcttttgtgttggtgtgcatgctgtccttcagtttgtctcctcttcccacaccctgtcatgtgctcctaaaactccccctttacttggctactttatctggcttggcaaagctttcccatatcccctgacccatgtcagggaacgtttctcctcattgctgtcatggcaccctgtgtgtggctctgaccagactttgctatccgctttgatttctgtctttcaggggctaagtcctgcctacatcctcagtcagcatgctgcctaacacataacagatcctaagcaaatattgggtggatgaaaatcactaccattcaaggcttcattgtatttatcagtaaaactgaaataatatctaatggggtcgagaagatttactgaaaatatatatttgaaagggctttgcagttttaagtactgtacctatgtgcattgctgttacattcaggagatttctgagttttagacagtcccaagcttcagcttaaaatctgtagactgcagcccgtttctgaaacgtttgtactacgtgttgactaggaggaacaatgacagactctgtagtcaccggaaatacttaaggaatcatgaggtactatgtatttccttaaattatactgttttttaaagctgaagtatctaatagttaatgggttgtccaaatttgtcagaacatttgactgtaatttaatgtctcaccatttttcaaaaagatatattaataccaaatattaaaatgtgtcaagact

SEQ ID NO: 116602 - DNA, 1835 bp, Homo sapiens
  Payload ID: 2740
  Gene Symbol: CEP63
  Gene Name: centrosomal protein 63kDa
  Uniprot ID: Q96MT8
  ENST ID: ENST00000354446
  CDS Start-End: 288-1715
acgcaagtccctttcctcccgacacgagtgcagtaaagaaaaacggttatgagcgtaaagtgacagcctcggccgatgggaatagggggaagtccgacactgagcaacgaacgcattcccgcgcctccaaaacctaggccgggggcgctggaaacccttaccggcacccggccaccgcggcagacgcttgctcctgccacgccccccccccctcccccgcatcacgtgtctgcactcgctttcctcggattcccggatgtggttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagagatggggttttaccatgttgtccagtctggttttgaacttcgggattcaagcaatccgccagcctcagcgtcccaaagtgctggaattacaagtgtgagctaccaccactggcagttaagaattttaacaatttgtcaatgaaacaagaatctcaattagagtctttatatacaatctgtactgttggaattttcaaataaatattgtaaagaaaatt

SEQ ID NO: 116603 - DNA, 2028 bp, Homo sapiens
  Payload ID: 2740
  Gene Symbol: CEP63
  Gene Name: centrosomal protein 63kDa
  Uniprot ID: Q96MT8
  ENST ID: ENST00000383229
  CDS Start-End: 172-1797
gttcatttgctcgcgtgcaggggaagtctggagaaggcattgtttcaattattaaaagtgtgggggcagtgggcggaacaaacgcgccgactacagaggctggacgtaagcttagcggtggcgcgcgtgcgcagcgccggcccgagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataaggccacgggaagaatctctggcagaaaagaagtacacctctcaagggcagggggacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcactatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctag

SEQ ID NO: 116604 - DNA, 464 bp, Homo sapiens
  Payload ID: 2740
  Gene Symbol: CEP63
  Gene Name: centrosomal protein 63kDa
  ENST ID: ENST00000508778
  CDS Start-End: 1-464
gaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcag

SEQ ID NO: 116605 - DNA, 566 bp, Homo sapiens
  Payload ID: 2740
  Gene Symbol: CEP63
  Gene Name: centrosomal protein 63kDa
  ENST ID: ENST00000512894
  CDS Start-End: 378-566
aacggcgggaaggctcaggggcgtgcttgcggcaaccctgtaaccgccggtgcgcaagttggaggggcaaggggctgccgtgtcctggtctggaggcggcccaggctgccttggtgattctggcttcgcggcctcatggcttgcggccggtttgcgcaacggcctgcgaaccaccaggcgcgtccccgccggcttgggtccgccccgaagcccagtccctcggcctggcccgctatgccctgcacactggcggagtctggcgtggcgcagcccggcgtggggttcggccccgccaggtggtcagcccttcctcggagtccaggtggctgggggcgcttcggagagtggccagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagt

SEQ ID NO: 116606 - DNA, 629 bp, Homo sapiens
  Payload ID: 2740
  Gene Symbol: CEP63
  Gene Name: centrosomal protein 63kDa
  ENST ID: ENST00000511574
  CDS Start-End: 142-629
gatgtgggtgagttcatttgctcgcgtgcaggggaagtctggagaaggcattgtttcaattattaaaagtgtgggggcagtgggcggaacaaacgcgccgactacagaggctggacttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgattta

SEQ ID NO: 116607 - DNA, 2903 bp, Homo sapiens
  Payload ID: 2740
  Gene Symbol: CEP63
  Gene Name: centrosomal protein 63kDa
  Uniprot ID: Q96MT8
  ENST ID: ENST00000513612
  CDS Start-End: 428-2539
gtgcttgcggcaaccctgtaaccgccggtgcgcaagttggaggggcaaggggctgccgtgtcctggtctggaggcggcccaggctgccttggtgattctggcttcgcggcctcatggcttgcggccggtttgcgcaacggcctgcgaaccaccaggcgcgtccccgccggcttgggtccgccccgaagcccagtccctcggcctggcccgctatgccctgcacactggcggagtctggcgtggcgcagcccggcgtggggttcggccccgccaggtggtcagcccttcctcggagtccaggtggctgggggcgcttcggagagtggccaggggcccccaaacccggggccgcagagcagtaccagtccgtggcctgttaggaaccaggctacagagcaggagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataaggccacgggaagaatctctggcagaaaagaagtacacctctcaagggcagggggacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgaggcaaaagagatttcactagcagacctccaggagaattatattgaggcattaaataaattagtgtctgaaaatcaacaactacagaaagatttgatgaataccaaatctcagctggagatttctactcagatgtgcaaaaaacaaaatgacaggatctttaaaccaacacacagcagaacaactgagttcaagaatacagagttcaagccaacccatggccagcacagacatgatggaataaagactgagcactacaaaacagatcttcattctccaagaggacaagcgtcggatagtataaaccccatgtctagggtgctaagccccctgagtcctcaaatcagcccttgcagctccaccaggtctttgacttcctactctctatgtaaaactcattctttgccttcagcgctagatacaaatgaagccaatttttctgacactatgtctgagagtatgaatgaccaagaagagtttatatcttcgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcactatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagacttttttctcatacgaatatttattatcataaagtgatacttaccttgctgacttaaatgtgaatagctatgtactaattgaaataaggattttatgatacatgttgaaaataaagtaactgcaggaacttt

SEQ ID NO: 116608 - DNA, 735 bp, Homo sapiens
  Payload ID: 2740
  Gene Symbol: CEP63
  Gene Name: centrosomal protein 63kDa
  ENST ID: ENST00000504929
  CDS Start-End: 1-735
aggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgaggcaaaagagatttcactagcagacctccaggagaattatattgaggcattaaataaattagtgtctgaaaatcaacaactacagaaagatttgatgaataccaaatctcagctggagatttctactcagatgtgcaaaaaacaaaatgacaggatctttaaaccaacacacagcagaacaactgagttcaagaatacagagt

SEQ ID NO: 116609 - DNA, 707 bp, Homo sapiens
  Payload ID: 2740
  Gene Symbol: CEP63
  Gene Name: centrosomal protein 63kDa
  ENST ID: ENST00000514678
  CDS Start-End: 1-585
gacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagagatggggttttaccatgttgtccagtctggttttgaacttcgggattcaagcaatccgccagcctcagcgtcccaaagtgctggaattacaagtgtgagctaccaccactggcagttaagaattttaacaatttgtcaatgaaacaagaatctcaattagagtctttatatacaatctgtactgttggaattttcaaataaatattgtaaagaaaattaa

SEQ ID NO: 116610 - DNA, 2800 bp, Homo sapiens
  Payload ID: 2740
  Gene Symbol: CEP63
  Gene Name: centrosomal protein 63kDa
  Uniprot ID: Q96MT8
  ENST ID: ENST00000606977
  CDS Start-End: 329-2440
gtgcgcaagttggaggggcaaggggctgccgtgtcctggtctggaggcggcccaggctgccttggtgattctggcttcgcggcctcatggcttgcggccggtttgcgcaacggcctgcgaaccaccaggcgcgtccccgccggcttgggtccgccccgaagcccagtccctcggcctggcccgctatgccctgcacactggcggagtctggcgtggcgcagcccggcgtggggttcggccccgccaggtggtcagcccttcctcggagtccaggtggctgggggcgcttcggagagtggccagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataaggccacgggaagaatctctggcagaaaagaagtacacctctcaagggcagggggacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgaggcaaaagagatttcactagcagacctccaggagaattatattgaggcattaaataaattagtgtctgaaaatcaacaactacagaaagatttgatgaataccaaatctcagctggagatttctactcagatgtgcaaaaaacaaaatgacaggatctttaaaccaacacacagcagaacaactgagttcaagaatacagagttcaagccaacccatggccagcacagacatgatggaataaagactgagcactacaaaacagatcttcattctccaagaggacaagcgtcggatagtataaaccccatgtctagggtgctaagccccctgagtcctcaaatcagcccttgcagctccaccaggtctttgacttcctactctctatgtaaaactcattctttgccttcagcgctagatacaaatgaagccaatttttctgacactatgtctgagagtatgaatgaccaagaagagtttatatcttcgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcactatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagacttttttctcatacgaatatttattatcataaagtgatacttaccttgctgacttaaatgtgaatagctatgtactaattgaaataaggattttatgatacatgttgaaaataaagtaactgcaggaa

SEQ ID NO: 116611 - DNA, 1601 bp, Homo sapiens
  Payload ID: 2740
  Gene Symbol: CEP63
  Gene Name: centrosomal protein 63kDa
  Uniprot ID: Q96MT8
  ENST ID: ENST00000620544
  CDS Start-End: 174-1601
gagttcatttgctcgcgtgcaggggaagtctggagaaggcattgtttcaattattaaaagtgtgggggcagtgggcggaacaaacgcgccgactacagaggctggacgtaagcttagcggtggcgcgcgtgcgcagcgccggcccgagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagagatggggttttaccatgttgtccagtctggttttgaacttcgggattcaagcaatccgccagcctcagcgtcccaaagtgctggaattacaagtgtga

SEQ ID NO: 116612 - DNA, 5343 bp, Homo sapiens
  Payload ID: 2741
  Gene Symbol: CEP68
  Gene Name: centrosomal protein 68kDa
  Uniprot ID: Q76N32
  ENST ID: ENST00000260569
  CDS Start-End: 111-1973
tcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcggcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaaaccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaacggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaaccta

SEQ ID NO: 116613 - DNA, 5847 bp, Homo sapiens
  Payload ID: 2741
  Gene Symbol: CEP68
  Gene Name: centrosomal protein 68kDa
  Uniprot ID: Q76N32
  ENST ID: ENST00000377990
  CDS Start-End: 204-2477
agcgcggccgaagggcgtggttggcgctcggtcctgccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcggcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaaaccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaacggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaaccta

SEQ ID NO: 116614 - DNA, 3768 bp, Homo sapiens
  Payload ID: 2741
  Gene Symbol: CEP68
  Gene Name: centrosomal protein 68kDa
  ENST ID: ENST00000537589
  CDS Start-End: 881-1765
agggtccgccagctcggggccagcgcatggggctgctgagaccgctccggacgtgcgaagcgttcgcggtgcggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaaggtaatgacactcaacgttaggaagctttgtgtacaggtgtcttgtctcttcccccaatccactaacatcataataaaacatgttcatgttgaccaggcactttttatgtgccaggcattgtgctgtaccttatcttattcagtcctcacaacttttaccaggtaagcactgttctcattttactttttggaggaaagagcagagagaggttaggtaacgtgcccacttataattagcaagggcttgagccaagaatgagacccaggtagactatttgcagaggctgagctcttagccactacccttggctgcttcctaactcagaggtattctgaacaaaaaaggttttgtgcacagatgcctttaggaaacactgggctaaacaaaggtaagtggctttcttgactgcaggacttctagagcttcatttgccacagtggtttaagtgcaaagttaggggcattggatgtactgttgcctagactttgtggccaccggaccatcttgtgaaccaaatgacttaatatctggaggtataaagaacactgcgtggaatagggttatcggtgtcaggcatctgaatttgaaacatggcactgctgtctttggaatgttggctcagcctcttgagtttgctcatttgtaaaatgtggagccctgccttcttaggatgttgtgtgcattaaataattcatgttgagggcttcggtgcattcccagacatgttgaaggttcaggaatgtgcctgtccaggaacgtgtcctagcgcttgcggggggctttcaccttcccaggaggtgacgtggttattttgtcttgtgaggtaggtaggacacgttatcatggacccctctttactgataaaagattgagatgccatgaggtaaagttgttcttcgctatagcttcaggttagtcatgattttagtcatttattttacgttcacttttccagagaaacatggacgtatctggctccaagatgctgattctagttagtaatggtgctgatccaagaattggtttccatggcaggcacgcctcttctgggctgctccattcctacctgcaaggctgggttttctcagcctgtcatttttgatgtcacaccaggctgtggttttcattgctttggcagagggaggtacagagtcgtggagtcgggacaggtgagcaaggaggagagaggaaactgaagacattttgctgtcagctggaagagctgatctgctggctgtataatgttgcagatgttactgaccacgggactgcagccaggtccaatcttacaagtctcaagtcttctctgcagctttaccgggtaatatgcggtcctggctctggcttgttccctcacaagagtgtggctaaattactcgattacaaagtaaaatctcaaataaccaatgtctggtatgttatagctcagttgactattatacctgaaatctaattagagcttcacattcttaaagcggaacgctttgtaaaatgcatgaattatttcccaggccaaatggagcttgaagatacaatatatttatctcaaatcaaaaatactttaggttttgggctggcaggtgcagtgggacaagtcttttatcccagctactctggaagctgagacaggaagattgcttgagcccaggagttcgagtacagcctgagcaacatagcaagacccccccccctcaaaaaaaagttttttcttaattaaaaacaaaaatactttagggtgatttgcaatataattttccaaatgtctcagggattataaatacagacttgcactattatgacgcctctagttatgtatggctattgaagtaaaattaaagactcagatttttttatttgcactagccacattctgcatgttcaaccatcacatttgtctagtggctaccacgtagaacagtgcagatgtagaacacttccatcaccacataaagtcctattggactgcaccactatttaaagatctgagctgaaattgtactgactccagaatctacaatagggcattttgatggtatttaaatagaaatctaggccaggcaccttggctcacactattaatcccagcactttgggatgctgaggctggaggatcgcttgagcccgggagttccagaccagcctgggcaatatagtgagacctcgtctct

SEQ ID NO: 116615 - DNA, 2732 bp, Homo sapiens
  Payload ID: 2742
  Gene Symbol: CEP70
  Gene Name: centrosomal protein 70kDa
  Uniprot ID: Q8NHQ1
  ENST ID: ENST00000264982
  CDS Start-End: 268-2061
attcgcaggccaaagaggggctggccctcgacgcgctcgggctcgattggccgccctcccccggcggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgtttctcacttccaaaagttatttgatgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtataatttttattaactttgagattcttatacagaaaatagttgcaagggtaaggtaattaactttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaaagcaggaggaagaaaaggaagaaagaaaaactgtttcatcatttctgttagggtaggaaatgaatcatagggtaaaatggatgagtagatagaagtctctcatttaaaaagtgtcttttgcaatcttgatgtaatgcactttttataaggacttgagatctcaaataaaatttctgtaaagaatttccaaa

SEQ ID NO: 116616 - DNA, 2037 bp, Homo sapiens
  Payload ID: 2742
  Gene Symbol: CEP70
  Gene Name: centrosomal protein 70kDa
  Uniprot ID: Q8NHQ1
  ENST ID: ENST00000481834
  CDS Start-End: 160-1824
agcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgtttctcacttccaaaagttatttgatgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagaggtatttgttttaaaagtttacaaagtatcatccagaatggctgggtgtggtggcacacgcctgtagtcccagctacttgggaggctgatgtgggaggatcacttgaacccaggagtttaagtccagtctgagcaaggcagtgagaccctgtctctaaacaataaaaattaaaataagtattatcgagagttcctggaggggtgaaattaaagactttcaaaactta

SEQ ID NO: 116617 - DNA, 1021 bp, Homo sapiens
  Payload ID: 2742
  Gene Symbol: CEP70
  Gene Name: centrosomal protein 70kDa
  ENST ID: ENST00000462419
  CDS Start-End: 243-1021
aaagaggggctggccctcgacgcgctcgggctcgattggccgccctcccccggcggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaa

SEQ ID NO: 116618 - DNA, 1811 bp, Homo sapiens
  Payload ID: 2742
  Gene Symbol: CEP70
  Gene Name: centrosomal protein 70kDa
  ENST ID: ENST00000489254
  CDS Start-End: 217-1554
cgggctcgattggccgccctcccccggcggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgtttctcacttccaaaagttatttgatgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtataatttttattaactttgagattcttatacagaaaatagttgcaagggtaaggtaattaactttagatcccttcatttctaaagcaattattgagtgcttaaaatttaa

SEQ ID NO: 116619 - DNA, 1016 bp, Homo sapiens
  Payload ID: 2742
  Gene Symbol: CEP70
  Gene Name: centrosomal protein 70kDa
  ENST ID: ENST00000468900
  CDS Start-End: 136-1016
ggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaa

SEQ ID NO: 116620 - DNA, 569 bp, Homo sapiens
  Payload ID: 2742
  Gene Symbol: CEP70
  Gene Name: centrosomal protein 70kDa
  ENST ID: ENST00000459695
  CDS Start-End: 1-216
ctctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaatggctctttgcttttagaagaggagatgaagcttggtatgaaaataagggaatgagtcaatgaaaacttgataagaagaataagtgaaagaagtatctaattagaatatatagcctactgaacataaaggaagttttgtgaccagtcttatgtgcagtggggaagcaagggagacaatgagtgagcttgctttaggcttgtcctcatgtttaaaaagatcacagcaagtgaaaatgtaatttgaaagttaaacttgagatgaggtatgaaactgtataagtgtgttgtctgatatcctgaagagcctggtttcatagaataatatgattcttgctttgggattgctattaacttaagcagtgatgttctcatcattcataaatatttggcacattaataaacatattttaataggg

SEQ ID NO: 116621 - DNA, 598 bp, Homo sapiens
  Payload ID: 2742
  Gene Symbol: CEP70
  Gene Name: centrosomal protein 70kDa
  ENST ID: ENST00000485115
  CDS Start-End: 530-598
tcacctgggcctaaaagtggtcagactgacccttgtcggggaggagccatctgggacagggtcgcgccaattaaaaatccctgcgtaagggtttggggatcggacaaaactgcctccagtcccagctccccaggctttgtgttctttggcttctcctttaatgtctcagcgcctccgattctttatttgtatactaaagctggtaattcttgccttacaaggtggttgtgagggttaaatgaggcagtaagagtaaagcttagaatcacgtcgggcacagactcgatttaagctgtaggtaattactccatcccccaaaatcgacccgggctgaagcgctagttttgtgtcaaacaaccgcgaaggttgtttggggagtgaggactcggagcagaagggggcggttaggcgaatagcacagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacag

SEQ ID NO: 116622 - DNA, 1993 bp, Homo sapiens
  Payload ID: 2742
  Gene Symbol: CEP70
  Gene Name: centrosomal protein 70kDa
  Uniprot ID: Q8NHQ1
  ENST ID: ENST00000484888
  CDS Start-End: 188-1981
ctggtgggaggccggcgactgagtaagatgaagatccagtttcagacatgagactcgttgggtgatcatttcattgagatcaacctgaatgaccaggtgtaaagtgcaagagtaatatgctatgactgaggcaactcaaattttttaattgccaatttctgtttcttttgattctacaaaagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgtttctcacttccaaaagttatttgatgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaa

SEQ ID NO: 116623 - DNA, 1054 bp, Homo sapiens
  Payload ID: 2742
  Gene Symbol: CEP70
  Gene Name: centrosomal protein 70kDa
  Uniprot ID: Q8NHQ1
  ENST ID: ENST00000464035
  CDS Start-End: 161-799
atgaagatccagtttcagacatgagactcgttgggtgatcatttcattgagatcaacctgaatgaccaggtgtaaagtgcaagagtaatatgctatgactgaggcaactcaaattttttaattgccaatttctgtttcttttgattctacaaaagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagtaattttgctacataaattgatatgtagctagattcattgttgtgtttgtttgtttgttttacctgatattatcttgggggtggttataactcttataaactagaaaagcctctctctcctcctcttctgcattgtttttccctgctcatcctgttcttttttttttttttttttgttctagaggtcctttgaagaatggaattgaacatttactaaaaataacactaaacttttaaataaattcataattaatcaga

SEQ ID NO: 116624 - DNA, 551 bp, Homo sapiens
  Payload ID: 2742
  Gene Symbol: CEP70
  Gene Name: centrosomal protein 70kDa
  ENST ID: ENST00000470159
  CDS Start-End: 204-551
ataagcctccatgtaagtgacagggcacccaaggagtgcgttggaagcgccagcgtgcccgagaccagcacatcgcaccgacgccttcgtttgcgatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaa

SEQ ID NO: 116625 - DNA, 2028 bp, Homo sapiens
  Payload ID: 2742
  Gene Symbol: CEP70
  Gene Name: centrosomal protein 70kDa
  Uniprot ID: Q8NHQ1
  ENST ID: ENST00000474781
  CDS Start-End: 287-2026
gggctggccctcgacgcgctcgggctcgattggccgccctcccccggcggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgtttctcacttccaaaagttatttgatgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaa

SEQ ID NO: 116626 - DNA, 2434 bp, Homo sapiens
  Payload ID: 2743
  Gene Symbol: CEP72
  Gene Name: centrosomal protein 72kDa
  Uniprot ID: Q9P209
  ENST ID: ENST00000264935
  CDS Start-End: 91-2034
ggctctcggttctgccgacgcaggtcccgcccctctcgtagcctcgccccgcccgccgcgcaggcgccgtccgagggctccgtttgaaacatggcgcgggctggccctcggctggtgctgagcgaggaggcggttcgggcgaagagcggcttagggcctcaccgcgacctggctgagcttcagtcattgtctattcctggaacttaccaagagaagatcacccacctgggacattctctgatgagtttaacaggtctgaaatctttggatctctcgcgcaactccttggttagtctggagggcattcagtacctgactgcattggagagtctcaatctctactacaactgcatctcctcgttggcagaagtgtttcggctccacgccttaaccgagctcgtggatgtggacttccggctgaaccccgtggtgaaggttgagcctgactaccgcctttttgttgtgcacctgctccccaagctccagcagctggacgatcgccccgtgagagcaagcgagcggaaggcttcccgactgcattttgcatcagaggactcactcgactccaaagagagcgtcccagcttctttgaaagagggcagaccacaccaccccagagccaagtgcaccgaggccttggccaagcagagcctggtcatggatgcggatgacgaggcagtcctgaacctcattgcagagtgcgagtgggacctcggcaggcctcccgggagcacgagcttcagccagaaggggcgtgaggccgactctcgtggttcccaagaatccagacatctgttgagcccgcagttggtacagtaccagtgtggggactctgggaagcagggccgtgagacgaggaggagcagctgcagagggtgctgtctggagaagatgccttggagccagctctgtggagagcttccgccactgtacggagcggagccagaggcctcccgtgcccccaggccacacacgtacttcaccccacacccagactccatggataccgaggactcggcctcttctcagaagttggatttgtcaggagaaatggtgcctggtcccctgccagcccccggaaagtgcaggaagcgaagaatgcctgttggaagattccagacgttttcggaccaggagggtttgggctgcccggagagaactcatgggtcctccgtgcccaaggagagcctgagcagacaggacagctcagaaagcaggaacgggaggaccttgtctcagcctgaggcctcggagactgaggagcagaggtctcggggtgtgaccgacaccagagagccgtctcccgggtcacactcggctctacccgggaagaagacggccctgcaggcggcgctcctggagacgctcttggacctggtggacaggagctggggcggctgcaggtccctgcacagcaacgaggcattccttgctcaggcaagacacatcttgtcatctgttgaagaattcacagcagctcaggacagctctgcgatggtgggtgaagatgtcggctccctggctctggagagtaagtccctgcaaagccgccttgctgagcagcagcagcagcacgcccgggagatgagcgaggtgacggcggagctgcaccacacacacaaggagctggatgatttgagacaacatttagataaatctttggaagagaacagtaggttaaaatcgcttttgttgagtatgaaaaaggaagtgaagagtgcagacactgcagccacgttaaatttgcagatcgctggacttcaaacaagtgtgaagaggctgtgtggcgagattgtggaactgaagcagcacctggagcactacgacaagatccaggagctcacgcagatgctgcaggagagccacagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtaaagttacattgtctgcacctttgtacttctttattgagtgtactggctggcaagagttctctcttctgttggtaattatttaggatttttggaatgtattcaggacctgtagcttggttttctaaagcacctcgtaaaatgatatgattactccaagccctctgcatgttttcagacagaacacattgacatattttgagacaaactgactattaatcttgtatccagtatcctgagatgaagtaaatgcagtgttctactgcctgatgtgaaagagagctatgtatgataattaaagaaaataattttctgtgtaacaagcaatctttatttaataaacaaatacattgttctgaaaa

SEQ ID NO: 116627 - DNA, 528 bp, Homo sapiens
  Payload ID: 2743
  Gene Symbol: CEP72
  Gene Name: centrosomal protein 72kDa
  ENST ID: ENST00000625371
  CDS Start-End: 17-528
gggctccgtttgaaacatggcgcgggctggccctcggctggtgctgagcgaggaggcggttcgggcgaagagcggcttagggcctcaccgcgacctggctgagcttcagtcattgtctattcctggaacttaccaagagaagatcacccacctgggacattctctgatgagtttaacaggtctgaaatctttggatctctcgcgcaactccttggttagtctggagggcattcagtacctgactgcattggagagtctcaatctctactacaactgcatctcctcgttggcagaagtgtttcggctccacgccttaaccgagctcgtggatgtggacttccggctgaaccccgtggtgaaggttgagcctgactaccgcctttttgttgtgcacctgctccccaagctccagcagctggacgatcgccccgtgagagcaagcgagcggaaggcttcccgactgcattttgcatcagaggactcactcgactccaaagagagcgtcccagcttctttgaaagagggcag

SEQ ID NO: 116628 - DNA, 2939 bp, Homo sapiens
  Payload ID: 2744
  Gene Symbol: CEP76
  Gene Name: centrosomal protein 76kDa
  Uniprot ID: Q8TAP6
  ENST ID: ENST00000262127
  CDS Start-End: 227-2206
gtttgtccgccactgtttgaaaacagttggcgccgccgccgccggggcctcatttccaggtcagcccccggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattaccacttttgtggtttattcgtggtccttgggatatttgagactgtccagaaatttatggttggaccttgaagcaagagtaggaaaaaactaataccagaaaagcataaatattaataacctcatatgaaagtacatgaatcatttagaaatatttatcactgtgatttgttgtaaaaatgaattgggtattttagaaaaactttattatacctctttgttatgatactgataaattgtgatcttgcagtcga

SEQ ID NO: 116629 - DNA, 2197 bp, Homo sapiens
  Payload ID: 2744
  Gene Symbol: CEP76
  Gene Name: centrosomal protein 76kDa
  Uniprot ID: Q8TAP6
  ENST ID: ENST00000423709
  CDS Start-End: 175-1929
tttccaggtcagcccccggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaagtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagtt

SEQ ID NO: 116630 - DNA, 2380 bp, Homo sapiens
  Payload ID: 2744
  Gene Symbol: CEP76
  Gene Name: centrosomal protein 76kDa
  ENST ID: ENST00000590143
  CDS Start-End: 92-316
agtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttacttgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtgaatgtgcctcttaggagcacttgtccagaagtgtctgggaaaagcttgggctgcacagtgatggtgctccctgaaagactcagagcagcacagccagtacctccagagtatgaagcatgaagtacacttattctacaagaataagaagtaaatataaaaaaagtcaaggattcaatttttaataaagtaacaaaatcaacaaaacaaaatcatattcagagtaacatggacttcacagcactttgaaaaagacatttaaatgttgatttgagttgttcagacattttaaatatgaagtcatagagtaaaaatacaatcaatgactgaaattggg

SEQ ID NO: 116631 - DNA, 534 bp, Homo sapiens
  Payload ID: 2744
  Gene Symbol: CEP76
  Gene Name: centrosomal protein 76kDa
  ENST ID: ENST00000587666
  CDS Start-End: 1-534
aatataaaacttgaaatgtatccaccactcaatcaaacgttatctcaagaagtagtgaacacacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctggga

SEQ ID NO: 116632 - DNA, 3309 bp, Homo sapiens
  Payload ID: 2744
  Gene Symbol: CEP76
  Gene Name: centrosomal protein 76kDa
  ENST ID: ENST00000593250
  CDS Start-End: 120-344
ggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttacttgttgagcaagaactcccttcctctccaaaacaacctatttgttttgatagacaatcgacattaaaaaaaagttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagatagagtctcactctatcgcccagggtggagcacggtggcatgaactcggctcactgcaacctctgcctcccgggttcaagcaattctcctgcctcagcctcccgagtagctgggattacaggcatgtaccaccatccccagctacttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaaggtattatacacacataatagaattaagtagcagtatatcatagttactctgaatttgtaatccatttgtaaaagaatgccttagaaaaatgcacatatagtcaaccctctgtacccacaggttctgtatctgtagattcaaccaactgcagatcaaaaatacttacaaaagtaaaaaattacaataataaaaaatagtacaaattaaaaaatggtgtgtaacaacgtttatgtagcatttacattgtattgagatttttaaacaatttagaggtgatttaaagtatataggaggatgtgcttaggttatatataaaatactataccattttggctggccgcagtggctcatgcctgtatcccagcattttgggaggctgaggcaggtggatcacctgaggtcaggagttcaagaccagtctgggcaacatggtgaaaccctatctctactaaaatacaaaaaattatctgggcatggtgtcgtgtgcctgtaatcccagctactcaggaggctgaggcaggagaatcacttggaccctggaggcggaggttgcagtgagctgagatcgcaccattgcactctagcctgaggacagagcaagacacgtctcaaaaaaaaaaaaaatactattttatataagccttgagtatccacggattttgttttgcaagggtcctggaactaaccgctttggggtgctatcagcttgaccacgtcagaaccttgttctgtttttcataacatttaaatatcaatacacaaaaaactcagcatctttattttctcatgtagtttcttatttattgtgatttctgtgatgtagggacctacaagtactaaaatgtcagaaatcaagttgcagaatgaattaggaacagcaccaggaccagaccatggctttctggtactactgatgtgttgcaatttgctcagataatacatctttaaaaaagagaaaataaggctgggcgtggtggctcatgcctgtaatcccagcactttgggaggcagaggtgggtggatcacctgaggtcaggagttcaagaccagtctgaccaacgtggagaaactccgtctccactaaaagtacaaaattagcgtggtgtggtggcacgtgcctgtaatcttagctactgaggaggctgaggcaggagaattgcttgaacctgggaggcggaggttgtggtgagctgagatcgcgccattgcactccagcctgggcaacgagcgaaactccataaaaaaaaaagagaaaatggcagtacaaaattaatatagaaaaaatattaaaatagaaaaaaatcttgaattgcatgctatttagtttgtttagtttgtatttaaatacaaatgtatatttaattacactttttgaatgacttgattttagtaaactaattttatagattatgggatatttcctaatctgtgttctaaaaatgttgatagtatgataacaaacaagtaaaactatctttaggccaggcgcggtggctcacgcctgtaatcccagcactttgggaggccggggagggtggatcacctgtggtcgggagttctagaacagcctggctaacatggagaaactccatctctactgaaaaaatacaaaaattagccagccatggtggcgggctcctgtaatcccagctacttgggaggctgaggcaggagaatcacttgaacctgggaggtggaggttgcagtgagccgagatcacgccatcgcactccagtgtgggcaataagagcaaaactccatctcaaaaaaaaaaaacaaaaaactatctttagcctgggtgacagagcgagactctgtctcaaaaaaaataaataaaggtgacagcaggccaggcatggtggctcatgcccgcaattccagcacttgggtaggccaaggtgggcaaatcacttgagcccagaagttccagacaaacctgggcaacatggcaaaatccctctctcta

SEQ ID NO: 116633 - DNA, 787 bp, Homo sapiens
  Payload ID: 2744
  Gene Symbol: CEP76
  Gene Name: centrosomal protein 76kDa
  ENST ID: ENST00000587929
  CDS Start-End: 209-547
gaaaacagttggcgccgccgccgccggggcctcatttccaggtcagcccccggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaagttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgac

SEQ ID NO: 116634 - DNA, 684 bp, Homo sapiens
  Payload ID: 2744
  Gene Symbol: CEP76
  Gene Name: centrosomal protein 76kDa
  ENST ID: ENST00000585751
  CDS Start-End: 1-576
gagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggtttgtaaattatattagaataattttatgcctgtatttgagatttactgttatgtgtgtaaatttcatttaatatttatttgtaaaatgtattccaaaaaataaaagtgtatttgtaaaataaaa

SEQ ID NO: 116635 - DNA, 413 bp, Homo sapiens
  Payload ID: 2744
  Gene Symbol: CEP76
  Gene Name: centrosomal protein 76kDa
  ENST ID: ENST00000591034
  CDS Start-End: 1-305
aatggcgatcggttttgggctcagaaaatggagtgaccagtctgactgtggaacttatgggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggtttgtaaattatattagaataattttatgcctgtatttgagatttactgttatgtgtgtaaatttcatttaatatttatttgtaaaatgtattccaaaaaataaaagtgtatttgtaaaataaaa

SEQ ID NO: 116636 - DNA, 2542 bp, Homo sapiens
  Payload ID: 2745
  Gene Symbol: CEP78
  Gene Name: centrosomal protein 78kDa
  ENST ID: ENST00000277082
  CDS Start-End: 120-2237
cggggctgccgctatcgcctggccgtgggtgccggagcggccgggttgcgactcagcgttcttgggtgggcgcgggcggcgtctccgcggcgggcatcccccgaggccgccctcgggccatgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgttttta

SEQ ID NO: 116637 - DNA, 2618 bp, Homo sapiens
  Payload ID: 2745
  Gene Symbol: CEP78
  Gene Name: centrosomal protein 78kDa
  Uniprot ID: Q5JTW2
  ENST ID: ENST00000376597
  CDS Start-End: 145-2313
cgaatcaccgctcctgagcccggtgcggggctgccgctatcgcctggccgtgggtgccggagcggccgggttgcgactcagcgttcttgggtgggcgcgggcggcgtctccgcggcgggcatcccccgaggccgccctcgggccatgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattgtaggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccaggtttctatttgtatgcagtcagcttacaatgaaggaacactaatgaagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgttttta

SEQ ID NO: 116638 - DNA, 2404 bp, Homo sapiens
  Payload ID: 2745
  Gene Symbol: CEP78
  Gene Name: centrosomal protein 78kDa
  Uniprot ID: Q5JTW2
  ENST ID: ENST00000376598
  CDS Start-End: 1-2118
atgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccaggtttctatttgtatgcagtcagcttacaatgaaggaacactaatgaagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacagaatcccattgaaatgactggagaaatattaaaataaaaataatagcagagttggaaaaccagaaatttgaacagtgaaatttctggaagataagaagcagatgatttaagtaccagttaattaaaggatggaacagctaagccattccactcatctttggagcatctgattctggagtttgccaccaggctaagaaagcagctatctgaagtgggagctctgacccaagaaatgctgggatcggagaataagggaattatccaaaatggctccgaagaggaactgaagttaagctgc

SEQ ID NO: 116639 - DNA, 2623 bp, Homo sapiens
  Payload ID: 2745
  Gene Symbol: CEP78
  Gene Name: centrosomal protein 78kDa
  Uniprot ID: Q5JTW2
  ENST ID: ENST00000415759
  CDS Start-End: 190-2310
tgaggggccggcctagcttggggctctggccttgcgtcttccgaccgaatcaccgctcctgagcccggtgcggggctgccgctatcgcctggccgtgggtgccggagcggccgggttgcgactcagcgttcttgggtgggcgcgggcggcgtctccgcggcgggcatcccccgaggccgccctcgggccatgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattgtaggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgtttttattatggca

SEQ ID NO: 116640 - DNA, 11198 bp, Homo sapiens
  Payload ID: 2745
  Gene Symbol: CEP78
  Gene Name: centrosomal protein 78kDa
  Uniprot ID: Q5JTW2
  ENST ID: ENST00000424347
  CDS Start-End: 290-2359
ggcaccgcccaccggcttgaatcccggcgcctcagaggactatgaggcgggcgccaactgcttgggccgcagggcgggaggcagcgcgggagtggggcgttgaggggccggcctagcttggggctctggccttgcgtcttccgaccgaatcaccgctcctgagcccggtgcggggctgccgctatcgcctggccgtgggtgccggagcggccgggttgcgactcagcgttcttgggtgggcgcgggcggcgtctccgcggcgggcatcccccgaggccgccctcgggccatgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacagaatcccattgaaatgactggagaaatattaaaataaaaataatagcagagttggaaaaccagaaatttgaacagtgaaatttctggaagataagaagcagatgatttaagtaccagttaattaaaggatggaacagctaagccattccactcatctttggagcatctgattctggagtttgccaccaggctaagaaagcagctatctgaagtgggagctctgacccaagaaatgctgggatcggagaataagggaattatccaaaatggctccgaagaggaactgaagttaagctgcccacatgatctctctaactatgatgacctgccacttccgtttataatcaccatataagtgcctgtaatcatttgtgttcattaaaagtgaaccagaattcccatttggatgaaaaaataacacttccaactttaatcttaggccctcatttataaatatggacaaccaagaatcatcaaatttgaagaaaaccagtaacataaaaggaggcatgaaattaaaattaacctgttcaagaagatagttactaggagaaacatgaaatttttaaattaatgaatcaaaatcttcagcaattcataaagatactgtgttcataaagaataggatgccatgaaaaaaatatttagagtttctggaaattaaaaatttgattatgaaactgaaacactcagaagatggactacacagcagaatggattcatttgaagcttaaattcatgaaatggaaggtattaattggtcttagacgtttcatcagcaacttaattacttagaaaaaatctttctcagagtaactaagcaaaatgaacaatgaacccattaacgtgtggttttgttttttgggttttttttttttgagtcaaggtctcactcatgtcacccaggctggggtgtagtgatgggatcacagcttattgtaaccatgaaccattgggcttaaattatcttcccacctcagcctcccaagtagctgcaatgtaccaccatgccgaagttttaaaaaattattgtagagttgggttctttctttcttttctttttttctttttttcttttttttttgagacggagtctcgctctattgcccaggctggagtgcagtggtacaatctcagctcactgcaacctcctcgatctcagctcactgcaaccgtgaagtgatcttcctgcctcagcccccctagtaactgggattacaggcacacaccaccatgcctggctaatttttgtatttttagtaaagacggggtttcaccatgttggccaggctggtctcgaactcctaacctcaggtgattcacccacctcggcctcccaaagtgctgggattacaggcatgagccactgcatccggccaagatgggttctttcttaggctggtcttgaactcctggcctcaaatgatcctcccaccttggcctcccaaagtgctgagactacagacctgagccactgtgcccagccccatgaaagatgtttagatcaaataaactgataaagatattgataaagatatgagacaaactacttcagctttgtgacctgcaaatccccttttataatcaccagaggtgcctgtagtcagaaaaagtctaaataaatactaatgacatatgaaaacaaagtccaaccaaagttctaggtttgaacatgaatggaggcatggcaggacacagaaagtgaaagcttgtcctagatattgtcttattcatgggaaggatacaggtagtgtttgattctaggtattgattgaaaaaatatattaaaatatatataaagttaagggtatgttagtaaggataggttaggtgatgttgcattaacagctcccaaattttaattactttcaacaacataggtttatttgtgcccatgcagtttgcctttggcagattggctagaggcccctattcaacatcaacctcaatctggaagcgaggctggtggaacgtcactatttggaacattgctggttgcagtgtccaaggaaagacagtatgatgcagcatatattgtgacttaaagcttctgtctagatgtgacatatgtcacttctgttcacatttctttggccaaagaaagtcacatggttatgcctgagttcagcagaccagggaagtgcagaattgccatttgccatgagaagagagggaagcaaatgtatgtcaacaactttaatagctacaaaactacctggaaagagggaatggaatttttaggtccaacaagacgggaaagaaaaagaaacaagctacatagaaataaaaaatccacaatatagcaagatcaagttttttactcataataaacatgaacaggttaaattctggaatccttaggcttgagtaaaaacatgaaatcccactgtgtgctatttgcaaaatctaaaacgctgtcatagattataaagagatgaacaaaaatataccaggcagatgctaaagagtaaatgtggctgtgttagctgcagactaaatagaacccaaggtgaaaattggtaaaggggacaaaagcttcttttggctgataagtacagtgttgcagaagattttttaaaaaaatatatctgcaatttaaaaacttgatgttaggccgggcgcagcggctcacgcctgtaatcctagcactttgggaggccgaggtgggtggatcacctgaggtcagaagttcaagaccagcctggccaacatggcaaaactccgtctctactaaaaatacaaaaaaaaaaaaaaaaaattagctgggtgtcatggcgcatgcctgtaatcccagctactcgggaggctgaggcaggagaatcgcttgaacctgggaggcggagtttgcagtgagctgagatggcaccgctgcactccagcctgggccatagaggagactccgtctcaaacaaacaaaaaccttcatcttaaaattatagggtaagaatttagaaatacaaggaaaaatggccagccagttataacaagaagctttaagacatctcttttcagaatcagtggatcgactgctgcacacacactagaatggctaacattttgaaatgctgataaatatgcagagcaactggagttcctcacagctggtaggaatgcaaaatgactcagtcactcaaaacagtttggcagattctttaaatgctaacatacacataccatatgaccaagcagtcccactcctgggtatttagagagatgaaaacttagttcacacaaaacctgtgcgtggatatttatagcagctccattcatagtgaccaagatgtcttccaacaggtgaatggatagcgatgtatccatatggtggcaaacatgccacaattcggatgaatctcaacatcatatgctgagtgaaaaagccagtctcggaaggctacattctgtatgattccatttatatggcattcttgaaaagacaaaactatagtgacagaacagattggagattgccaggtgttggggttgggaggagttgattacaaagaggctgtacaagggagtttgtttgtttgtttgttttggtgatgaacagttctgtatcctgattgcggtggtggtaacgtgagtctatacatatgttaaaatttatagaactgcatactctcaaaaaaattagttttactctataataatattagagcttaaaaaattcatccctcttgcccatcagtagatcaggatatgaaggataccattgaacataaatattttgtatccatgatgaatacaaagtatattctcctggaaaaccaatagaacattcatataaatgattcctatgaaggtaaaaaacttacaaaattcaaagatcatacagatcatgtgctctgtataatgtaataatagtaacaaaaggcctgtccacttggaaatttttaaatgatcttctaaataactcatttaaaggagaaatcaaaataaattgcaaattatttagaattaataaaaacttctctaaagctgaggaattctaccaaagaggtgttagaggaaattgtatagattttgatttactttccaggaagaaagaagacaaaagagatgaattaaacatttaaagctaagaaagagataaaccaaaagaaaggtgaggaattggtaaaagcagaaatgaataaaatagcaaattttgatcagtgaaacacaggtttttaaaaatgaaagataaacctttgtaaaatatgataaagaaaaaaaagcaagaagtaattaacaaaaattgccagcattaggaataattttagaaggatacctacaactagaagagatatttttaattatgagcacttttataatttactataaataattgtgtagtgttaaaccaataaatttgaaagactagatgaaatgtgactgtttaaaaatatggattgtaaaaattgataaaaaatagaaaatgtaaataaacgaaacatcttaggagaaattgaaaaaataggacaagaacttatttttaaaaagaggccaggtgcggtggcccatgcctgtaataccagtactttgggaggccgaggtgggcggatcacctgagatgaggagttcaagaccagcctggccaacatggtgaaaccccgtctctactaaaaatacaaaaattagccgggcttggtggcgggcacttgtaatcccaactactcaggagtctgaggcatgagtgtcgcttgaacctgggaggcagaggttgcagtgagctgaggtcacaccgttgcactctagcctgggagacaagagggaaactctgtctccaaaaaaaaaaaaaaaaaaatacagttagaaaaactttaaaggggccaggtgtggtggctcatgtctgtaatcccagcactttgggacaccaaagtgggaacattgctgagaccagcagtttgagaccagcctgggcaagacctcatctctacaaaaattaaaaaacaaaacaaaacaaaaaaacccaaaacttagccaggcatggtggtgcgtgcatgtagtcccagccactcaggaggctgaagtgggaggatcgcttgaggccgggattcgaggctgcagtgagctgtgatcatgccaccactgctctctagcctgggcaagagtgagactccgactcaagaagagaaaaagaaaaaccttccaggggcacatttatttgtaaaccattccagaggatagaaaagagatgtaaggctccctaattcattccatacggttagcgtaatccttatagcaaactgcacaaataaaacacaaggaaaactaaaccaaattcaattaatgtaggtgcaaaaaatccaaaataaaactagcagtttgaattcagcattgtagcaaaagatatatcattttcaaggaagatttgtaccaaaacatgcaagattgagtgaagagtaactcactgtagctcactaaattaacagattaaagaagtatagtcatcttcacaagctgaaagagtatgtgataaattcaacatcctctggtattcttaacaatctcgaaatagaaggaaacttccttagcttagcttcttggcttcattaaatatacctaacagaaatccacaggaaacaaacttggtgaaaagtttttgctaagataaaaacggtactaaaaagtacacattttgggaaatgagacaaggctctcgttatttgtaaatatggggtctttttttttttggacaaaaaaccccctgtgatgatctactggcatgctattacagctaataaagctgaataaggaggctgtgcacaacaccaacacaccggtatgaaaagtgtgtacaccagcaataaccaattagaaaatgtatgaggaaatagactctcatccacaatagctgcgagaagtaaatattatctagaaataagattaacaagagaaatgtaaggcctatataaataaaaggataaatctatgctagagggtataaaagaaacacaaaaatagaggtatgccatgtataagacccaacataataaatagttctaccaaattaatttataaattcaaagcaatttcatataaccacagtaaagctttttaaatggatgtaataacctgattataacattaatctgaaagtcatcaggcataaagcaattttgattacatctcaaaacaatccatggagttagggtaaatgtgctgttcacacaggaataatcacaggtatagaaccgagaacctaggaacagagcaatgtatatatatatgtatttaaaaaatggcatcacaagtcagtagagaagggtttgaactattcagtaaatgatgttgaggttatttactactttttcttatttcatatcatggatgaaaaaaatcaagatgaattaaacatggaaattaaaaataactagaagaaaatactggaaaaaaattgtaataaatgtgtaagaaaggcattcccaaccaagacacaaaacccagtagccatgaaaaaaaagatagatttgactacatttttaaaaagtaaaacctttcactttttacaaaactttgataaaattagatttcataaataaaggagtgggaaaatacatgtaatagaacagaagatttaagataatataaagagcacctacaaacaacaaaaattggacaaaggctataaaaatattttataaataagaaatacagactataaacataaactttcaacctcgtaagcaatcaggaaaattaaagttaaaatgagatactatttttcaatacattgaaatggcagattattaaagattggtgatagtgctggagataatgtgaggaaaggagtattctcagtcattgtagaaattgatacagcttttggatggacagtttgacagtgtgtatcaacatgtgaaatgtctccagcctttgatctaatgactaattttaggcatccagcctgaagaaatattcacacaagtgcccaaagagtcagatacaagactgtgtgaagtgttttttgagataataaaaaactagaaacagcataaatgtacagaaatgcagaaattgttgaattagtacataccaatttctgacatataacactctgcagcagataaagacaatagctctctagtgtggacatgaaaatatttctaagacattgacaggacgaagaagttgcacagtaaccacgcactcctgtttacatttgtatagttaaaacttgtttacctatacgtagcatatatgcgtgtgtgcaccctagaaaagagtctgtgataacacatatcaagctattgacagcggttttgtctgctgaaggaggaaaaaaggggggcttctcacattttactccatttaattctaggttgtttggtttaaaaaaaaagtttttatgtacaacagacaatttttaaaattccttttcatcatagaaaatgaaaatgtgtactctgttatcctttacgctctgtccatttttttcttcaaaaatgtgtctgacctattatcaatgtgaatgaaaatgagctttgctacataacctcttttcagagctttgtattcctgaagtgttggagtcgcctacatggcatagtcaaatgtttttaacttaaccacaacccacagtaaaaatgaagctttctgcaaagttaaaagtagtagtcctggccccaccttccttgtgtgcacgtataattaatggaaaattgcatcaaacaactctgattgtacttctagtgactaattcatgttctgttctattccttgcctttaaagaaaattatgttggcaactcacgaagtatgtttcacaatccactaatgggtaatgtcctactgtttggaaacactggctagagtgtttcaaacatctgctctgtttacccctgacaaaactgctactcgtggggcaatgcaagtctttcccacatttgttttattttatggctaaaagtcatttctgcatttgcaaattacttccaaagcctaccttccttgagctctttaactctctatagtcttctggtaattttctttagatttcccttttcagaacccttttgtgacactgaaaacctgagttttcaaactgatacatctacctgagaattttcacatataatttggtcaaaaagttaaaaaataagaagactttgccctgtgactgaggtgctcagaaggtatggctggctgctcacaaaggcacatagtgagtgataggggctgaaagggctcagagaatgcccgagttctcttagtacagtttgtacattttaaaccactgtgaactgaaaaaaaaaaaaaaggcaaccttggtagtttagaaatagataaggacccacttatagattaaataataattagcttgttccagagagaccagtgaagattagttggtttatttaatgtgttagaaagatggtcctcaaagtccttgaaatgtgaaggcggcttttatctccttaagaaaacaagaaaactccacaaaatcttgaaagctagataatcctagcttaaatgataaaatttgagtagagtttgaaaacactaaaatcagtttgccaaataaccagctctaatttctttataccaaagccaaacttcacctaaatcttacctaagaattgagttccttattgtaaccagataggagacacttttgtatattattccaaatattgcaaacctacaaggagtaaaaggtgttattattttaaagaagaaggaatgaggcctgagaggtattgattcacttggttgagggcttcaagtagcacaaggcaaaagcaggatttgttgacttccaaacctgttttcttccttcaccatgtggcctttgcatctttcccacacaaatattattccacaaatatttattgtcaccaactataataaaagaacagaactatgtatca

SEQ ID NO: 116641 - DNA, 3130 bp, Homo sapiens
  Payload ID: 2746
  Gene Symbol: CEP83
  Gene Name: centrosomal protein 83kDa
  ENST ID: ENST00000339839
  CDS Start-End: 492-2597
gagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctggaggctgaaaaacaatcagctaatttacgggcagaacgtttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaatttttttttaa

SEQ ID NO: 116642 - DNA, 2737 bp, Homo sapiens
  Payload ID: 2746
  Gene Symbol: CEP83
  Gene Name: centrosomal protein 83kDa
  ENST ID: ENST00000397807
  CDS Start-End: 493-1911
gcaggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctggaggctgaaaaacaatcagctaatttacgggcagaacgtttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaattttt

SEQ ID NO: 116643 - DNA, 3773 bp, Homo sapiens
  Payload ID: 2746
  Gene Symbol: CEP83
  Gene Name: centrosomal protein 83kDa
  ENST ID: ENST00000397809
  CDS Start-End: 551-2656
gggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtatagggaggacacctctggattgaggatcttatgacctactttagaggaaggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctggaggctgaaaaacaatcagctaatttacgggcagaacgtttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaatttttttttaatcgtgtgtttaattttacatcaaccatatagcatatatttagcaatatgacagtctactgattttggctttgttagaatagagaataagtgcaaataattaaatcctatggctgtattaacaagggggccattgattataaaacttgaactcaggtccttttataaacattgttggtatttaactttacttcccattactgtggatctaaccaaataattatgtgttttgtgtccctaagtatgctctcattttttttggtctacacccattggaagcctttttaatgtgacatcttttagaggaattctgctggaataatttcatgttaacgaggctaaagctcaagtctcccaaattaagtggaatgttcattatcccaaggtgttcatagtcaaaagtcccagttgatagtgaagaaggccaggactgtaattgagcagtccttagcaccatttagcaaactaggtttacttactacataatatagctgcttattcacagcatatacagtgacaccttatctctgaaaaataatttccacggagccacttagaataaaaaaactattataactagaaaatt

SEQ ID NO: 116644 - DNA, 705 bp, Homo sapiens
  Payload ID: 2746
  Gene Symbol: CEP83
  Gene Name: centrosomal protein 83kDa
  ENST ID: ENST00000552632
  CDS Start-End: 1-498
gaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagagatgggggatttggagcaccaagggtaaaaggtgcctgccacaagaaaagctcaagagttgccaattatgctgtttacttcttctggtttaatagaaggaaaacacagtggtattaaaactggtcatgagcagcaaaaattcaggaattaaaaaatcagcactaaaaagactacagta

SEQ ID NO: 116645 - DNA, 644 bp, Homo sapiens
  Payload ID: 2746
  Gene Symbol: CEP83
  Gene Name: centrosomal protein 83kDa
  ENST ID: ENST00000546527
  CDS Start-End: 638-644
gggtgggacttcctgcttcgcgtgccgctgggccaagggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtatagggaggacacctctggattgaggatcttatgacctactttagaggaagagccagctttagagtttgcccctctgcttatgaaatccctatggaaaaaaggtataatttggcttcctgagattctgccttagcaagaaaggagtgggaaatacccttggaaagaaaactaaaacagtaagaaagccaaaacttatttttacatggttg

SEQ ID NO: 116646 - DNA, 2166 bp, Homo sapiens
  Payload ID: 2746
  Gene Symbol: CEP83
  Gene Name: centrosomal protein 83kDa
  Uniprot ID: Q9Y592
  ENST ID: ENST00000547232
  CDS Start-End: 236-1942
aagcggagttgagtgggtgcctgtggttggagctgtggaggtgtccccggtggcgagcgcggccagaactgcggtcacttaagttttccgtgtgcgggttgcaaggagcgtgcgtgcgtctggtataatttggcttcctgagattctgccttagcaagaaaggagtgggaaatacccttggaaagaaaactaaaacaacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctggaggctgaaaaacaatcagctaatttacgggcagaacgtttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagcttgaacaggatcttgagttgggatgcccttctgtgactgatacatacagagagagtgtattccccccacccccattgaagagagatctcttgaagtgaacacaagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagca

SEQ ID NO: 116647 - DNA, 3122 bp, Homo sapiens
  Payload ID: 2746
  Gene Symbol: CEP83
  Gene Name: centrosomal protein 83kDa
  ENST ID: ENST00000547575
  CDS Start-End: 551-1609
gggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtatagggaggacacctctggattgaggatcttatgacctactttagaggaaggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctggaggctgaaaaacaatcagctaatttacgggcagaacgtttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggtaatatgtgatttcccttgctgctgctgctgctgcttattttcagatatgaactcaaattattaaaatagttgaatctgaatttttatttccaaattttcaacttaatttagttttaattttggagtacatatgaaatgtttattatatgttgagtgttttgttcattgtaagatttaataactttaaaaaaatcagtcttatgtttttatcatagttattggatacataaatgaattttgtaaatgggatgccatacttcctgatttataaattttaaatctatttatggtgtagttattagtcccaggacattttaagtctggagaatgtgaggaagataattgggttccaggcttaatttttttcaattaaaaagatttttttatgtagacctcaggccagttcattgtagcctagtgcagagtaggcttatttatttattttttatttttattttttatttttgagatggagtctcgctctgtccccctggctggagtgcagtggcgtgatctcggctcactggaagctctgcctcccaggttcacgccattctcctgcctcagcctcccaaatagctgggactacaggcgcccaccaccaggctggctatttttttgtatttttaagtagagacagcgtttcaccgtgttagccaggatggtcttgatctcctgacctcgtgatctgcctgcctcggcctcccaaagtactgggattacaggcatgagccacgcccagccgagtaggcttatttttaagttccagtttaatcttggaacatctgtctcatcagatttcctcattatttatgttgtttctaacttgaagtatttaaataagcttacctttggcctgtagctatgcttgagttgatctgtagttgaactcatttcagacagagtttatgatgaatgcctttcatgttttgaaatggggtctcaccatgttgcccaggctagccttgaactcctgggctcaaatggtcctcctgcctaagcctcctcagtagctgggactacaggtgctaacaccgtgtctggctgctatgaatgattttttccaattgttaatttctatttattgactcatggatttccatagagttaagaagtaaatttttttaggaacttaaagaatgctgcattttgttttcactttgagttagatgtgaatttgctttagttattccatctgcaaagtatttgccatttcattgcaaagatttctgaattcattgtacaaacttgaaagtgtccatgttatttatacttctgctagagatctagcaattctgctagaatcaataggttttgaagggttttgtgatttatttcactctgctatcagccagctttttctatgaggcttaggtcacagaacctctttagaggtgaagtaagtaaacctctggttatcatccagtttgatctcaactctcaatgttcgaatgagtaaatgtatacagcttttattaaagtttttatatgtgtatgcactaaataaacagtgacaggaaaa

SEQ ID NO: 116648 - DNA, 3935 bp, Homo sapiens
  Payload ID: 2747
  Gene Symbol: CEP85
  Gene Name: centrosomal protein 85kDa
  Uniprot ID: Q6P2H3
  ENST ID: ENST00000252992
  CDS Start-End: 132-2420
gcaacggccgttagaggagctgagggagggaaccaccgctcaccgcagacgtggtggctgcagtcagtcttcccgagtgagggatttcgccgcccgctttcaggcccgtttggcttaaataactgtgattgatggccatgcaggagaaatatccaactgaggggatctctcacgtcacttcaccgagttccgatgtgattcagaagggcagttccctggggactgaatggcagaccccagttatctcggagccctttcggagccgcttcagccgctgttcaagtgtagccgacagtggggacacagccattggtacatcatgctcagatattgcggaggatttttgcagctcaagtggcagtcctcctttccagcccatcaaaagccacgtaaccattccaacagcccatgtgatgccttctactttagggacctctcctgccaagccaaattctacacctgttggaccctcttcctctaaactccctttgtcagggttggctgaaagtgtgggaatgacaagaaatggagacctcggtgcaatgaaacattctccaggcctatctagagatctcatgtatttctctggtgctactggagaaaatggaattgagcagtcctggtttccagcagtgggccatgaaagacaagaagaggcgaggaagtttgatattcctagcatggaatctaccctcaatcagtcggcaatgatggagacactttattcagatcctcaccaccgagtccgcttccacaacccaagaaccagcacaagtaaggagttgtacagagtgttgcctgaggccaagaaggcaccgggcagcggggcagtgtttgagcggaatggaccacattctaatagcagtggggtcctccctttgggactccagcctgctcccgggctctccaagcctctgccctctcaggtgtggcagccgagtcctgacacttggcatccccgagagcaatcttgtgaactcagcacttgtcggcagcagctggaattgattcgtttacagatggagcaaatgcagcttcagaatggagccatctgccaccatcctgctgcttttggtccttcactgcccatcttagagccagcacagtggatcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtcaaaggtcgtgataaacatatcaataatttgaaaaagaaatgccagaaggaatcagagcagaaccgggagaagcagcagcgtattgagaccttggagcgctacctggctgacctgcccacactggaagaccatcagaagcagagccagcagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcagcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggctgattagggaactgtgtcctacccacactggcatgttggattacgtttgtcctgttaattcactctagacggtgagttactaattaacttttggcaggtacaacagataagtcctcacaaactgttcccagccctaggctgacatgagagacgaacaggctgtccacctttcttctccatccaatgggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggccacgtgtgggccagtcagccactacaagatttttgctaagctttgggctgttggcagcatcttggacctcatgcctgggcctgaatgaggctctttcttaagtgtttttacaagtttgtgttttatttatggagtgacttatcccttccattcagagcagccccacccagccagcccttcagcctctgggctcctgctgcttaaaggcagagccgcctggttggtctccaccctgtgcattgggagcccagccaccatgctgacgggtatttttcctcataaagtttataaccagttatttatatgaatctttgttatgtccatttgtttgtattgcgtattttgattataaaataaagtatcttaacagac

SEQ ID NO: 116649 - DNA, 2821 bp, Homo sapiens
  Payload ID: 2747
  Gene Symbol: CEP85
  Gene Name: centrosomal protein 85kDa
  ENST ID: ENST00000453146
  CDS Start-End: 1-1307
tcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtcaaaggtcgtgataaacatatcaataatttgaaaaagaaatgccagaaggaatcagagcagaaccgggagaagcagcagcgtattgagaccttggagcgctacctggctgacctgcccacactggaagaccatcagaagcagagccagcagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggctgattagggaactgtgtcctacccacactggcatgttggattacgtttgtcctgttaattcactctagacggtgagttactaattaacttttggcaggtacaacagataagtcctcacaaactgttcccagccctaggctgacatgagagacgaacaggctgtccacctttcttctccatccaatgggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggccacgtgtgggccagtcagccactacaagatttttgctaagctttgggctgttggcagcatcttggacctcatgcctgggcctgaatgaggctctttcttaagtgtttttacaagtttgtgttttatttatggagtgacttatcccttccattcagagcagccccacccagccagcccttcagcctctgggctcctgctgcttaaaggcagagccgcctggttggtctccaccctgtgcattgggagcccagccaccatgctgacgggtatttttcctcataaagtttataaccagttatttatatgaatctttgttatgtccatttgtttgtattgcgtattttgattataaaataaagtatcttaacaga

SEQ ID NO: 116650 - DNA, 4061 bp, Homo sapiens
  Payload ID: 2747
  Gene Symbol: CEP85
  Gene Name: centrosomal protein 85kDa
  Uniprot ID: Q6P2H3
  ENST ID: ENST00000451429
  CDS Start-End: 181-2316
gggtggggccaaacgacgcgcgttctgtggcgcgcggcctggcgggcgtgcaacggccgttagaggagctgagggagggaaccaccgctcaccgcagacgtggtggctgcagtcagtcttcccgagtgagggatttcgccgcccgctttcaggcccgtttggcttaaataactgtgattgatggccatgcaggagaaatatccaactgaggggatctctcacgtcacttcaccgaatttttgcagctcaagtggcagtcctcctttccagcccatcaaaagccacgtaaccattccaacagcccatgtgatgccttctactttagggacctctcctgccaagccaaattctacacctgttggaccctcttcctctaaactccctttgtcagggttggctgaaagtgtgggaatgacaagaaatggagacctcggtgcaatgaaacattctccaggcctatctagagatctcatgtatttctctggtgctactggagaaaatggaattgagcagtcctggtttccagcagtgggccatgaaagacaagaagaggcgaggaagtttgatattcctagcatggaatctaccctcaatcagtcggcaatgatggagacactttattcagatcctcaccaccgagtccgcttccacaacccaagaaccagcacaagtaaggagttgtacagagtgttgcctgaggccaagaaggcaccgggcagcggggcagtgtttgagcggaatggaccacattctaatagcagtggggtcctccctttgggactccagcctgctcccgggctctccaagcctctgccctctcaggtgtggcagccgagtcctgacacttggcatccccgagagcaatcttgtgaactcagcacttgtcggcagcagctggaattgattcgtttacagatggagcaaatgcagcttcagaatggagccatctgccaccatcctgctgcttttggtccttcactgcccatcttagagccagcacagtggatcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtcaaaggtcgtgataaacatatcaataatttgaaaaagaaatgccagaaggaatcagagcagaaccgggagaagcagcagcgtattgagaccttggagcgctacctggctgacctgcccacactggaagaccatcagaagcagagccagcagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcagcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggctgattagggaactgtgtcctacccacactggcatgttggattacgtttgtcctgttaattcactctagacggtgagttactaattaacttttggcaggtacaacagataagtcctcacaaactgttcccagccctaggctgacatgagagacgaacaggctgtccacctttcttctccatccaatgggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggccacgtgtgggccagtcagccactacaagatttttgctaagctttgggctgttggcagcatcttggacctcatgcctgggcctgaatgaggctctttcttaagtgtttttacaagtttgtgttttatttatggagtgacttatcccttccattcagagcagccccacccagccagcccttcagcctctgggctcctgctgcttaaaggcagagccgcctggttggtctccaccctgtgcattgggagcccagccaccatgctgacgggtatttttcctcataaagtttataaccagttatttatatgaatctttgttatgtccatttgtttgtattgcgtattttgattataaaataaagtatcttaacagactcctcagttttccatacccttccatcaccaccaccacgctattctacccctcactttggcttgttagagccaaacacctgggtgttcagccaggtcccccaggcagcagcgtggaggaacctttggcaggtccagccagcctcatgtccctatctatctctgccacctctgctcctctgtcgttctatagaaccagatctcttcccactcactttctcttgggcaaacct

SEQ ID NO: 116651 - DNA, 3507 bp, Homo sapiens
  Payload ID: 2747
  Gene Symbol: CEP85
  Gene Name: centrosomal protein 85kDa
  Uniprot ID: Q6P2H3
  ENST ID: ENST00000476272
  CDS Start-End: 134-2419
gtgcaacggccgttagaggagctgagggagggaaccaccgctcaccgcagacgtggtggctgcagtcagtcttcccgagtgagggatttcgccgcccgctttcaggcccgtttggcttaaataactgtgattgatggccatgcaggagaaatatccaactgaggggatctctcacgtcacttcaccgagttccgatgtgattcagaagggcagttccctggggactgaatggcagaccccagttatctcggagccctttcggagccgcttcagccgctgttcaagtgtagccgacagtggggacacagccattggtacatcatgctcagatattgcggaggatttttgcagctcaagtggcagtcctcctttccagcccatcaaaagccacgtaaccattccaacagcccatgtgatgccttctactttagggacctctcctgccaagccaaattctacacctgttggaccctcttcctctaaactccctttgtcagggttggctgaaagtgtgggaatgacaagaaatggagacctcggtgcaatgaaacattctccaggcctatctagagatctcatgtatttctctggtgctactggagaaaatggaattgagcagtcctggtttccagcagtgggccatgaaagacaagaagaggcgaggaagtttgatattcctagcatggaatctaccctcaatcagtcggcaatgatggagacactttattcagatcctcaccaccgagtccgcttccacaacccaagaaccagcacaagtaaggagttgtacagagtgttgcctgaggccaagaaggcaccgggcagcggggcagtgtttgagcggaatggaccacattctaatagcagtggggtcctccctttgggactccagcctgctcccgggctctccaagcctctgccctctcaggtgtggcagccgagtcctgacacttggcatccccgagagcaatcttgtgaactcagcacttgtcggcagcagctggaattgattcgtttacagatggagcaaatgcagcttcagaatggagccatctgccaccatcctgctgcttttggtccttcactgcccatcttagagccagcacagtggatcagcatcttgaacagtaatgaacaccttctgaaggaaaaagagcttctcattgacaagcagaggaaacacatctctcagctggagcagaaagtgcgagagagcgaactgcaagtccacagtgccctcttgggccgccctgccccctttggtgatgtctgcttgctgaggctacaggaattgcagcgagaaaacactttcttacgtgcacagtttgcacagaagacagaagccttgagcagagaaaagattgaccttgaaaagaaactctctgcttctgaagttgaagtccagctcatcagagagtcgctcaaagtggcgttgcagaagcattctgaggaagtgaagaaacaggaagaaagggtcaaaggtcgtgataaacatatcaataatttgaaaaagaaatgccagaaggaatcagagcagaaccgggagaagcagcagcgtattgagaccttggagcgctacctggctgacctgcccacactggaagaccatcagaagcagagccagcagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtgaggaattctgggggattcccccagggaggagctgggctgctgagagcctagtccagcaggtttctgccctgacattctcttgtctgctattcccagagaggtctcagaggggaggggagagcctgcatctgggggccaagggctgattagggaactgtgtcctacccacactggcatgttggattacgtttgtcctgttaattcactctagacggtgagttactaattaacttttggcaggtacaacagataagtcctcacaaactgttcccagccctaggctgacatgagagacgaacaggctgtccacctttcttctccatccaatgggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagccaccatgctgacgggtatttttcctcataaagtttataaccagttatttatatgaatctttgttatgtccatttgtttgtattgcgtattttgattataaaataaagtatcttaacag

SEQ ID NO: 116652 - DNA, 1736 bp, Homo sapiens
  Payload ID: 2748
  Gene Symbol: CEP85L
  Gene Name: centrosomal protein 85kDa-like
  Uniprot ID: Q5SZL2
  ENST ID: ENST00000360290
  CDS Start-End: 351-1535
ctctgagtgatgggcctactgcagagcccgcctcccaccacagtgctggcccagaattttttatacgaactagttcgtaactaaacgttggaagcatcaccatattgccagtgagaagcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagcctgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaagtaggtttttctaataaagttgaattaggtcaacaacatttcctcagcatataattatttgtctgtcatttaccctgtcaggtgtcatgccaggttatgtatacatttatgtggaggtgattaattttgtagtaacttttgagaagccctctgctgtctgcagaaatccaaggattttctttgaggatagaaatgctcttgtatatctttctaacaaatagtaaaatctttaaaaaattaattgcctacaccaaa

SEQ ID NO: 116653 - DNA, 7118 bp, Homo sapiens
  Payload ID: 2748
  Gene Symbol: CEP85L
  Gene Name: centrosomal protein 85kDa-like
  Uniprot ID: Q5SZL2
  ENST ID: ENST00000368488
  CDS Start-End: 68-2494
gcctatcatttgaagacgttccttgaggaggtttgaaaaaaaacagctgacccttggctaacattacatgatttggagaaataattggaagtctaccacagggagactaaatgtaaaactccaatcagataaattacaacacggatgtggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagcctgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaacttaaaactagagatcgatacatcagtagtctgaaaaagaaatgccagaaggaatctgaacaaaacaaagaaaagcagagaagaattgagaccttggaaaagtatctggctgatcttccaactctagatgatgtacagagtcagagtctacagctgcagattctggaagaaaaaaataagaatttacaagaggctttgatagatacagaaaaaaaacttgaagagatcaaaaagcagtgtcaagataaagagacacagttaatatgccagaaaaagaaagaaaaggagttagtaactaccgttcagagtttgcaacaaaaagtagaaagatgccttgaagatggaatccgccttcccatgttagatgcaaaacagcttcagaatgaaaatgataatctcagacaacaaaatgagactgctagtaagataatagacagccaacaagatgagattgacagaatgattttagaaattcagtctatgcaaggaaagctttctaaagagaaactgaccactcaaaagatgatggaagagctggaaaagaaagaaagaaatgtacagagattaacaaaagcattgcttgaaaaccaaagacaaacagatgagacatgctctttattggatcagggccaggaacctgaccaatctaggcagcagacagttctttccaaacggccactatttgatttgactgtgattgatcagctgttcaaggaaatgtcctgttgtttgtttgacttgaaagcattgtgtagtattcttaatcagcgtgctcagggcaaggagcctaatctttcattattactgggaataagatcaatgaactgttcagctgaagagactgagaatgaccacagcacagaaacactcactaaaaagctgtcagatgtgtgccagttacgaagagacattgatgaattaaggactacaatatcagaccgctatgctcaggacatgggagacaactgcattactcagtgatcaagtgttagtcccacagcaataatgacctgttgtttaaatgctgctgtgttatggagccataatggaaggttgcaagtgacatgacttgcacttagggattttttttctgtggatttgttttgttgaaggggagaagggaagtgaagagattttgaaggggcttatctaatcaggcaaaaagaaaaaaaatcaaattacctttggaaaatatgataaaatctacaaggaaaaaaatgtctatattctcaaactactgattgtaggaccaagctgtgaagagtacccttcacatgaaggagtaggattccttttaatcctatagctttgtgtgtttgtgtgtgcatgtatgtgtgttgttgtgtgtgtgtgcacgtgctttattcacaaatttataagggtttctagggtcagagcagagcttctgagaaaggcacacgctgtttattcttatatttctttcatatagaagcttgtgttgtactttgggattttcagtggctggctgaacaagagttcaaacagcaggcaagtgttgtcatggtagtacaggaggcaaaaccatttatattttgaacacttactgcactgataggatgtttgtggttgagctgattttagtactgtagataggtcagctgtttttccagagtgattgtggatttcccaagaggtgtgaaattttgacgtgatgctctttttccttagcattgtaatgtatgtgttacaagaaaggttaacataacttgaactaattttaacatgttccttactatttacaattttttatttatatgttttatatatatacatatataaatgtaaacaaagccatatataattaataaaggcattggatcattattataaaaggaagattaacaaagttaccctggaacaatagcttacttatccaaatctcaacatttacattttaacagttttgtatgtttcaaagttgaaactactgtaagagaaagccaatactatttatatctgaatcaacagtagcataaacattttttaattgagattgtattttaatcccttttgttaaagtacattaacaacagtttttcacaggatatgaacttggcgaaattagttcttaatctgaattacagggtattactatgaaatgcagttgattttgcagtagacgtacagtcatttaaacttccaaatgagtgttgtccatgtttctgttggtattttggaaggattatacattttattgccttcagcattgattatgttcttttgaatatacttagttttggcgaaagccttgtcctttgtaagttggtttgatcttgtgatgcaaccaagtctcatttaggtcaagactaaataagagatggaggggtagagggtgtgactcaagcaggataatattgatttgataaagagcatatcacatgcctgttttcttgccagataaagggcatagcacatgcctgttttcttatatactagaataaaggctctcctaggaaagatttttcttaaatatttaaaagtgaaaatgtgagacaaggccttcaaggagactacccaggaagatacacagtttaaaatgttggctatacagctctcaatagattattttatagttatagttgaataatcagttataatacactgtaaagaaatcagattttccttctgtttggtgtctgagtccttcctgctcttcttacttctgagaatctgggcactaagaaatcagtaagtacattgtagtgctcctgcatcccagagtccttaacctaaggagggtcttagtcactggtaagaacttggctttctaattatattcacttggtttttaacattagtagcttgacgataatcagggtatagtaaatttccaccaaaaatgtgatgcgaagaattctgccttggtcctttatggtaaaacagataataacgtctaaaatagatcagccacaagtgcagcaaatatttttacactctctttgaatagaatcccaaccaccctcccccatgattttagaaataaaggcttcctaaaataatagaacaaattggcaaacaatcactaattggaccagtaggttcttacttaaatatctctcctagatttttagtgtatgttttgggattttatgggtttatttatttttttttttttaagcagacgttacagtttgttttaatctactatagatacgtttttgttttttggcttagttggggataaaataatttatttgtaagttagctttctaaaacttagagaaagtaatttaattcacgtatcttaaaaataaaattccaaagttaaaaaatttctgacttagtaggaagttaacaaaactactgctgatgcatttcagtttccaaaatctgtaccctccccccataaaaaagggagttaagatgtgctagtttaagtagttagctgaattatagattgatcctcttaaaatctggagtttgtaaaggggcctacataaacagtagatagacttggagggattttgtgggggaattgaaactaatagtattctatctagtttgtcagtatttactttttgatttttatttttcagaaaattttcctttcccaggacaccctcttgtattagaatatcctcttctgtatcacattaaaaacagattttactgttagaccaaataagatgggcaaatagcaacactagagcatctcacccagtttgaactaggatgttcgtggaagttatgacaccaatatattcctgaaatgaaaattaacctaaattttaaagtgaatctatttgaaaatttacttagataatgaaacctcgttttaattgtgctttttgtgaatccaacacttgtttgcttagaaagtatcttatccagtattaatattttgttcttttgggttttaaagttgagcttattcagcctcaatcacattacagcaagcataaagtaacagttgactcaatgaaagacccaaattgcctgtacagataaaattcactgaatcaaaggcacaatagctatcttttcacttgagctcagaaaagtaaaatggcttaatttgaactattaattttcagtggcctctaattaaacaaaaacaaaaaaccacaaatactggctaggtaagatattcctgaggtcattttaaaagaagtgtggcacctaggattcaatatttaatgctaacagtattatattttagtgaaatttattttggtggtgacagtttattaaacctaattagacttctttcaatagcttgttgtagagacaatctcaagggctggaaagtgttgctaaaatgaatgtcatacatttctgatatactaaggagcttataaagtaattctttcatagtgcaagaattattaatttcttagaggatgtttttaaaggagctacttaattgggaaaatgttctttaaatatcagtaatagttcattaagtaacatagtagctaagaacatggactatattttcacagcatagttcagcttaggcacacctttagtttggattattggcattctcttacgtaggaattatatcattgtagatatgtaattatggtaataagcaattttcataaccatgctcactcagactatatcatttgaaactgccatgtttccatttttgacaattcatgttcacaaaacaacaggaacaatttcctatttggtataaagagcaaaatttccaactttgccccaaaatgccatgggtggcatattgccatatgattatatcatatatttaatcatgtatgggaaagattttggattttttttcttatttaaaaaagtgctaaatataagaatatagttttaaatcagcaagtctaataacactattgcagctgtacacagagagaaccttttgtgcctttttgcctgcagtaagcatttatttctattttacatgagttctaagaatgttgatgattattgcaccttgttcttctgtatataaacttgattaaggaatttttttttttaaagcaaggagccgttttttgttactaggtggataccttagtaaacatgaggggaattatcagatagatgtctttggagcccagccttccctgtgtagtgagctggaaactcctttagattgtattcattggtgtgtatgtatatgtacatatatgtataaatagttaaatacataaacataaaacttaacatcgcattgttgtgatgacaagaagtagtaaggtgctaggtggttacattaaaaagcacagcacagtgtataatcagtcactatgactggtggttttgtaagctgggttcagtttttgaaccacccagaatacctcatgtgtaaatacagtgttcatgacttaattgaaatacagttattgtttaaaaaaaaaaaaaaagaatgtgaagccactggttggcttatgccttctgatctatcattcttgcctctttttttgtaaaggggttttcttcttgttgttctgttttttaatagggtttacagctagaattttgaatgccaaagttctatttattaaattaagaaaaaagttttcaatgttaatggctagtatttttccactggactattgtttgttgatgttggaatttgtatttacagagaaataaatttttt

SEQ ID NO: 116654 - DNA, 7673 bp, Homo sapiens
  Payload ID: 2748
  Gene Symbol: CEP85L
  Gene Name: centrosomal protein 85kDa-like
  Uniprot ID: Q5SZL2
  ENST ID: ENST00000368491
  CDS Start-End: 623-3040
gggagggcgtgagggattacccaagggaggggcgagtatcgcaaaataggccaagtcgctgccctctactcaactcgcagggcgggaggatggagacagagggatgcggcgggagggcgggacagcccagtcgccgccaaggaggcgaagcggggtcggggtagctcacccgccccccgcagtccccgccccccgcagtccccgccccgcgcggcgccgcgcacgcctgaagtcattgcccgaggccccgccccctcgcggccccagccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagcctgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaacttaaaactagagatcgatacatcagtagtctgaaaaagaaatgccagaaggaatctgaacaaaacaaagaaaagcagagaagaattgagaccttggaaaagtatctggctgatcttccaactctagatgatgtacagagtcagagtctacagctgcagattctggaagaaaaaaataagaatttacaagaggctttgatagatacagaaaaaaaacttgaagagatcaaaaagcagtgtcaagataaagagacacagttaatatgccagaaaaagaaagaaaaggagttagtaactaccgttcagagtttgcaacaaaaagtagaaagatgccttgaagatggaatccgccttcccatgttagatgcaaaacagcttcagaatgaaaatgataatctcagacaacaaaatgagactgctagtaagataatagacagccaacaagatgagattgacagaatgattttagaaattcagtctatgcaaggaaagctttctaaagagaaactgaccactcaaaagatgatggaagagctggaaaagaaagaaagaaatgtacagagattaacaaaagcattgcttgaaaaccaaagacaaacagatgagacatgctctttattggatcagggccaggaacctgaccaatctaggcagcagacagttctttccaaacggccactatttgatttgactgtgattgatcagctgttcaaggaaatgtcctgttgtttgtttgacttgaaagcattgtgtagtattcttaatcagcgtgctcagggcaaggagcctaatctttcattattactgggaataagatcaatgaactgttcagctgaagagactgagaatgaccacagcacagaaacactcactaaaaagctgtcagatgtgtgccagttacgaagagacattgatgaattaaggactacaatatcagaccgctatgctcaggacatgggagacaactgcattactcagtgatcaagtgttagtcccacagcaataatgacctgttgtttaaatgctgctgtgttatggagccataatggaaggttgcaagtgacatgacttgcacttagggattttttttctgtggatttgttttgttgaaggggagaagggaagtgaagagattttgaaggggcttatctaatcaggcaaaaagaaaaaaaatcaaattacctttggaaaatatgataaaatctacaaggaaaaaaatgtctatattctcaaactactgattgtaggaccaagctgtgaagagtacccttcacatgaaggagtaggattccttttaatcctatagctttgtgtgtttgtgtgtgcatgtatgtgtgttgttgtgtgtgtgtgcacgtgctttattcacaaatttataagggtttctagggtcagagcagagcttctgagaaaggcacacgctgtttattcttatatttctttcatatagaagcttgtgttgtactttgggattttcagtggctggctgaacaagagttcaaacagcaggcaagtgttgtcatggtagtacaggaggcaaaaccatttatattttgaacacttactgcactgataggatgtttgtggttgagctgattttagtactgtagataggtcagctgtttttccagagtgattgtggatttcccaagaggtgtgaaattttgacgtgatgctctttttccttagcattgtaatgtatgtgttacaagaaaggttaacataacttgaactaattttaacatgttccttactatttacaattttttatttatatgttttatatatatacatatataaatgtaaacaaagccatatataattaataaaggcattggatcattattataaaaggaagattaacaaagttaccctggaacaatagcttacttatccaaatctcaacatttacattttaacagttttgtatgtttcaaagttgaaactactgtaagagaaagccaatactatttatatctgaatcaacagtagcataaacattttttaattgagattgtattttaatcccttttgttaaagtacattaacaacagtttttcacaggatatgaacttggcgaaattagttcttaatctgaattacagggtattactatgaaatgcagttgattttgcagtagacgtacagtcatttaaacttccaaatgagtgttgtccatgtttctgttggtattttggaaggattatacattttattgccttcagcattgattatgttcttttgaatatacttagttttggcgaaagccttgtcctttgtaagttggtttgatcttgtgatgcaaccaagtctcatttaggtcaagactaaataagagatggaggggtagagggtgtgactcaagcaggataatattgatttgataaagagcatatcacatgcctgttttcttgccagataaagggcatagcacatgcctgttttcttatatactagaataaaggctctcctaggaaagatttttcttaaatatttaaaagtgaaaatgtgagacaaggccttcaaggagactacccaggaagatacacagtttaaaatgttggctatacagctctcaatagattattttatagttatagttgaataatcagttataatacactgtaaagaaatcagattttccttctgtttggtgtctgagtccttcctgctcttcttacttctgagaatctgggcactaagaaatcagtaagtacattgtagtgctcctgcatcccagagtccttaacctaaggagggtcttagtcactggtaagaacttggctttctaattatattcacttggtttttaacattagtagcttgacgataatcagggtatagtaaatttccaccaaaaatgtgatgcgaagaattctgccttggtcctttatggtaaaacagataataacgtctaaaatagatcagccacaagtgcagcaaatatttttacactctctttgaatagaatcccaaccaccctcccccatgattttagaaataaaggcttcctaaaataatagaacaaattggcaaacaatcactaattggaccagtaggttcttacttaaatatctctcctagatttttagtgtatgttttgggattttatgggtttatttatttttttttttttaagcagacgttacagtttgttttaatctactatagatacgtttttgttttttggcttagttggggataaaataatttatttgtaagttagctttctaaaacttagagaaagtaatttaattcacgtatcttaaaaataaaattccaaagttaaaaaatttctgacttagtaggaagttaacaaaactactgctgatgcatttcagtttccaaaatctgtaccctccccccataaaaaagggagttaagatgtgctagtttaagtagttagctgaattatagattgatcctcttaaaatctggagtttgtaaaggggcctacataaacagtagatagacttggagggattttgtgggggaattgaaactaatagtattctatctagtttgtcagtatttactttttgatttttatttttcagaaaattttcctttcccaggacaccctcttgtattagaatatcctcttctgtatcacattaaaaacagattttactgttagaccaaataagatgggcaaatagcaacactagagcatctcacccagtttgaactaggatgttcgtggaagttatgacaccaatatattcctgaaatgaaaattaacctaaattttaaagtgaatctatttgaaaatttacttagataatgaaacctcgttttaattgtgctttttgtgaatccaacacttgtttgcttagaaagtatcttatccagtattaatattttgttcttttgggttttaaagttgagcttattcagcctcaatcacattacagcaagcataaagtaacagttgactcaatgaaagacccaaattgcctgtacagataaaattcactgaatcaaaggcacaatagctatcttttcacttgagctcagaaaagtaaaatggcttaatttgaactattaattttcagtggcctctaattaaacaaaaacaaaaaaccacaaatactggctaggtaagatattcctgaggtcattttaaaagaagtgtggcacctaggattcaatatttaatgctaacagtattatattttagtgaaatttattttggtggtgacagtttattaaacctaattagacttctttcaatagcttgttgtagagacaatctcaagggctggaaagtgttgctaaaatgaatgtcatacatttctgatatactaaggagcttataaagtaattctttcatagtgcaagaattattaatttcttagaggatgtttttaaaggagctacttaattgggaaaatgttctttaaatatcagtaatagttcattaagtaacatagtagctaagaacatggactatattttcacagcatagttcagcttaggcacacctttagtttggattattggcattctcttacgtaggaattatatcattgtagatatgtaattatggtaataagcaattttcataaccatgctcactcagactatatcatttgaaactgccatgtttccatttttgacaattcatgttcacaaaacaacaggaacaatttcctatttggtataaagagcaaaatttccaactttgccccaaaatgccatgggtggcatattgccatatgattatatcatatatttaatcatgtatgggaaagattttggattttttttcttatttaaaaaagtgctaaatataagaatatagttttaaatcagcaagtctaataacactattgcagctgtacacagagagaaccttttgtgcctttttgcctgcagtaagcatttatttctattttacatgagttctaagaatgttgatgattattgcaccttgttcttctgtatataaacttgattaaggaatttttttttttaaagcaaggagccgttttttgttactaggtggataccttagtaaacatgaggggaattatcagatagatgtctttggagcccagccttccctgtgtagtgagctggaaactcctttagattgtattcattggtgtgtatgtatatgtacatatatgtataaatagttaaatacataaacataaaacttaacatcgcattgttgtgatgacaagaagtagtaaggtgctaggtggttacattaaaaagcacagcacagtgtataatcagtcactatgactggtggttttgtaagctgggttcagtttttgaaccacccagaatacctcatgtgtaaatacagtgttcatgacttaattgaaatacagttattgtttaaaaaaaaaaaaaaagaatgtgaagccactggttggcttatgccttctgatctatcattcttgcctctttttttgtaaaggggttttcttcttgttgttctgttttttaatagggtttacagctagaattttgaatgccaaagttctatttattaaattaagaaaaaagttttcaatgttaatggctagtatttttccactggactattgtttgttgatgttggaatttgtatttacagagaaataaattttttataaaaaga

SEQ ID NO: 116655 - DNA, 1872 bp, Homo sapiens
  Payload ID: 2748
  Gene Symbol: CEP85L
  Gene Name: centrosomal protein 85kDa-like
  Uniprot ID: Q5SZL2
  ENST ID: ENST00000392500
  CDS Start-End: 172-1671
atttgaagacgttccttgaggaggtttgaaaaactcttacccggctctacaaattactgaagtccactgatagtccctccttcgtgaagcattcctgaagaccccagcctgacagatctccccttcctctgacctcctgtattgaaacagctgacccttggctaacattacatgatttggagaaataattggaagtctaccacagggagactaaatgtaaaactccaatcagataaattacaacacggatgtggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagcctgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaagtaggtttttctaataaagttgaattaggtcaacaacatttcctcagcatataattatttgtctgtcatttaccctgtcaggtgtcatgccaggttatgtatacatttatgtggaggtgattaattttgtagtaacttttgagaagccctctgctgtctgcagaaatccaaggattttctttgaggatagaaatgctcttgtatatctttctaacaaatagtaaaatctttaaaaaattaattgcctacaccaaa

SEQ ID NO: 116656 - DNA, 1797 bp, Homo sapiens
  Payload ID: 2748
  Gene Symbol: CEP85L
  Gene Name: centrosomal protein 85kDa-like
  ENST ID: ENST00000434604
  CDS Start-End: 68-1797
gcctatcatttgaagacgttccttgaggaggtttgaaaaaaaacagctgacccttggctaacattacatgatttggagaaataattggaagtctaccacagggagactaaatgtaaaactccaatcagataaattacaacacggatgtggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagcctgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaacttaaaactagagatcgatacatcagtagtctgaaaaagaaatgccagaaggaatctgaacaaaacaaagaaaagcagagaagaattgagaccttggaaaagtatctggctgatcttccaactctagatgatgtacagagtcagagtctacagctgcagattctggaagaaaaaaataagaatttacaagaggctttgatagatacagaaaaaaaacttgaagagatcaaaaagcagtgtcaagataaagagacacagttaatatgccagaaaaagaaagaaaa

SEQ ID NO: 116657 - DNA, 2079 bp, Homo sapiens
  Payload ID: 2748
  Gene Symbol: CEP85L
  Gene Name: centrosomal protein 85kDa-like
  Uniprot ID: Q5SZL2
  ENST ID: ENST00000419517
  CDS Start-End: 589-2079
agtatcgcaaaataggccaagtcgctgccctctactcaactcgcagggcgggaggatggagacagagggatgcggcgggagggcgggacagcccagtcgccgccaaggaggcgaagcggggtcggggtagctcacccgccccccgcagtccccgccccccgcagtccccgccccgcgcggcgccgcgcacgcctgaagtcattgcccgaggccccgccccctcgcggccccagccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagcctgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaagtaggtttttctaataaagttgaattaggtcaacaacatttcctcagcatataa

SEQ ID NO: 116658 - DNA, 5678 bp, Homo sapiens
  Payload ID: 2749
  Gene Symbol: CEP89
  Gene Name: centrosomal protein 89kDa
  Uniprot ID: Q96ST8
  ENST ID: ENST00000305768
  CDS Start-End: 90-2441
cctgcggcgggctttagggagtggtccctggctgtggatagatctgctgatgagtccaggccccggtccattctcctcgcgctgcaaggatgctcctgggatttcggagaggccgcaggagtcatttcaaacacatcatccatggccttttacctgcagccagcgttgctccgaaggcagctgtgccacgcacacctcctccccgcagccccaacccatctccagagagaccaagatctgctctggcagcagccattctggcgacaacattgactgggcggacggttgctattcctcagcctcgccagaggtcccggtctgagagtgatgtgagcagtgttgaacaggacagcttcatcgagccctatgccaccacctcacagctgaggcctcggccaaattggcagagtgagatgggaagaagatcttctttgccatcctttgaaacactggactatggggacgaagaggacattgaaactcagctgtcatccagcggcaaggaattgggggatgtcagtgcccgggaggacagaggaggccacagtgatgacctgtacgctgtgccacacagaaatcaggtgccattgttacatgaggtgaacagtgaagacgatgaaaatatttctcatcaagatgggtttccaggctcccctcctgcaccacagcggacacaacaaaaagatggtaaacaccctgttctgaatttaaaggatgaaaaacctccattatgtgagaaacctccaccctccccagatataactggtagagcacgtcaaagatatacagaaataaccagagaaaagtttgaggcattaaaagaagaaaatatggacctaaacaatatgaatcaaagccttacccttgaactaaacacaatgaaacaagcaatgaaagaactacagttaaaacttaagggaatggaaaaagagaagagaaagctcaaagaggctgagaaggcgtcgtcacaggaagttgctgcacctgaattactttatctgcgaaaacaagctcaagaactggtggatgaaaatgatggattgaaaatgactgtccatcgtttgaatgtagaactcagtcgatatcagacaaaattcaggcatttgtccaaggaagagagcttaaatattgaaggcctcccatccaagggccctataccaccctggttgttggatataaagtacctgtcaccattgttgctggcttatgaagatatgatgaaagagaaggacgagctcaatgccaccctcaaggaggaaatgagaatgtttaggatgcgagtccaagaagtggtgaaagaaaatgaagaattgcaccaagagttaaataagagtagtgctgttaccagtgaggaatggcgtcagcttcagactcaagcaaaactggttttagaggaaaacaagttgttgctggagcagttggagattcagcaaaggaaagccaaggacagccaccaggagcgcctccaagaagtttctaagctgactaaacaactaatgctcctggaggcaaaaacccacggccaggaaaaggagctggcggagaacagggaacagctggagattttacgtgccaaatgccaagaactcaaaacacactcggatggcaaaatcgcagtggaagttcataaatcaattgtgaatgaattaaaaagccaattacagaaggaagaagagaaagaaagggctgagatggaggagttgatggagaagctgacagtcctgcaagcgcagaagaagagcctgctgttagagaagaacagtttgacagagcaaaacaaagcactggaagccgaacttgaacgagcacagaaaatcaataggaaatctcaaaagaaaattgaggtcctcaaaaagcaggtggaaaaagccatggggaacgaaatgtctgctcatcagtacctggcaaaccttgttggcctggcagaaaacataacccaggaacgtgacagtcttatgtgtttggcaaaatgtttagaaagtgagaaggatggagtgcttaataaagtcataaaaagcaacattcgcctgggaaagttagaggaaaaagtcaagggctacaagaagcaggcagcactgaagctgggggacatcagtcaccgtctgctggagcagcaggaggacttcgccggcaagacagcccagtaccggcaggagatgcggcacctgcaccaggtgctgaaggacaagcaggaggtgctggaccaggcgctgcagcagaacagagaaatggaaggtgaacttgaagttatttgggaatctaccttcagggaaaaccgaagaatccgagaacttctccaggacacactcacgaggacaggcgtgcaggacaaccccagagctctggttgcccccagcctcaatggcgtctctcaggcagacctgctggacggctgcgatgtctgctcctatgacctgaagtctcatgcccccacctgctagaatctgcgggagcccgtggtgtagcctcctctggcctgaaaggtctgcctcacacaggccttccctgcagggcagcccatggtggcagccggaggtgcgtaagcccactgaacgctgcagggcagggaagaaataaatggtctcatagtttaatccattgataacattttgctttattttttaatttttttttttttttagagctagggtctcactctgttgcccatgctggagtacagtggtgcaatcatagctcacggcagcctcaaacatgtttgagatccttctgcttcagcctcctgagtagctgggacctcaggtgtgcactgtcaggcccagctaatttttttcttttttgttgagatgaggtcttgctatgttgctcaggctggtcttgaactcctggcctcaatctgtcctcctgccttggcctcccaaagtgcgggaatgacacgtgtgagccactgcgcctggcccattgtgctttattttaataacgtgctgctgaaatctgttttagccagggcatgttctctggccacattgccactgagatgagttctatgacacccactgctctggtgagtaggtggcctgctgagcaggcctgccttccagctcctagatctgcagctgggaagtgctggaagggttgggcgggcagctgagccctcgtgccatgtgtcagatggggaagtgtcacccgaggagccaggccatggcaccggccctgatgatagctgtgcgtgagctctgggggccttttcttgtttggtcaaaaaaaacaaggtgctgctgctgttcatgccctctaagttgtacaaaccttttctgccctctcccctagcccttctctatcctcctgagcaagtactttattctcttttgtttagttgttacttttgtttgtttgttttgagacagggtctcactctgttacccaggctggaatgcagtggtgcaatcaccacagccttgacctccaggctcaagcgatcctcccatcccagcctcctgagtaggtgagatgacaggtatacactaacatgcctggctaattttgtaaaaaaaaaatttttgtaggccagccatggtggctcactcctgtaatcccagcactttgggaggtcgaggcaggcggatcacccgaggccaggagttcgagaccagcctggccaacatggtgaaaccccatctctactaaaaatacaaaaattagctgggcatggtggtgggtgcctgtaatcccagctacttgggaggctgaggcaggagaattgcttgaacctggaaggcggaggttgcagtgaaccaagatcacgccattataccccagcctgggcagcctgggcaacaagagcgagactttgtctcaaaaaaaaaaaattttttttttggtagagatggggtcttgctatgttgcccaagctggtctcaaacgtctagcttcaagcaatcctcctgcctaggcctcccaaagtgttgggattataggtatgagccaccgcgcctggtctgggaaggtaattgattctggagccacacagctccccacccatgtaatgagagccctggctttgagctaagatagagtccctgccccactgccaccaccaagaagcataccagggggccatggttctgtcccatgtgtgttagatgacgtgccacctcctcaggaaaattaccccagccgctcaggaccattcagtcccaggcatgctggagggacttggggacattgggctacaaaggaccctaactgtgggactcaggggtggcaccctgcagcatctccttttcagagcccctcgcagtgaagtcctgccttgtttcaggtgggaaggaggccccagtactggtccttggtcatgtgtagaagttctacgtgtgatctttgattgccagacggaagggtgagatagaaaatcatagttcttttatgactctataagcttgttcaacagttgaatcattgtaatttaattttattttacaagcggtagaaagactcactgggattgaaaactgtgtatcatctccctaggagatgacctaacaaataactgtgatgctatttcaaaggcatttacggccgctctgcagcctcctgtagacaggctgacaggcggcggcagcccagcgtggctgcgcggggcaggagtgcttgtcagcaggaatgctgctcccgccatcgtgacctagagaaccactgttgacatccctgtctttctgccttttatgcaaacattttattcttttgagaagtgtccacttttgttcttatgtttctgctttaagtttttcacacagtgcaaacatactttgcaagtatggggactcctggatggcactgtgaccagggcaagggcaggtgtcccacagacactatcttctgcccagcctcctgctgggtgccataggaaatgggcagagaagccacgagtccaggatgccaaggagggcggggcaggcaaggcagagaggcacctgggtgcttgtgagattccaggaaaggacagaaacattggggtgcttctgggaggaactggcacgccccggcccttgcagagtggacaaggtttcaggagctacagaagggtggagagggcccccaggagcacagcaggcactcagagcagcaggagggggtttggtcagagcttgggtgggaaatgaggccggactgcacagaggagaactgggtctgctgggaggggctcctccttccccatgctgcaagtgtctggtctgagcagggaacccttctctttcttggtcctggtgaggtttcatacggcattggaagattcctggtcaagcagctgtagaacatgacccaggcacgcgagtgagccttgctggctttgccattatttaaaagcagccctgggcatggtgatggcgcctatggtttcagctactcaggaggctgaggtgggaggatcacttgagcctgggaggttgaggctgcagtgagctatgatcatgccactgcactccagcctgggcaaccaggtgagaccctgcctcaaaaataatacaataaaaagtaaaagcagccctggggaaatggagacagtggacaaagcaggctggggcaccaggtgtgcatgtgggtgtgagtctgtcatgagagctgtcctgaatgcccttaacgccactgaactgtatgctggaaaacagtgacaacagtggattttgttatatagacaattaaaaaagaaataacaccca

SEQ ID NO: 116659 - DNA, 2482 bp, Homo sapiens
  Payload ID: 2749
  Gene Symbol: CEP89
  Gene Name: centrosomal protein 89kDa
  ENST ID: ENST00000586984
  CDS Start-End: 82-1368
gggctttagggagtggtccctggctgtggatagatctgctgatgagtccaggccccggtccattctcctcgcgctgcaaggatgctcctgggatttcggagaggccgcaggagtcatttcaaacacatcatccatggccttttacctgcagccagcgttgctccgaaggcagctgtgccacgcacacctcctccccgcagccccaacccatctccagagagaccaagatctgctctggcagcagccattctggcgacaacattgactgggcggacggttgctattcctcagcctcgccagaggtcccggtctgagagtgatgtgagcagtgttgaacaggacagcttcatcgagccctatgccaccacctcacagctgaggcctcggccaaattggcagagtgagatgggaagaagatcttctttgccatcctttgaaacactggactatggggacgaagaggacattgaaactcagctgtcatccagcggcaaggaattgggggatgtcagtgcccgggaggacagaggaggccacagtgatgacctgtacgctgtgccacacagaaatcaggtgccattgttacatgaggtgaacagtgaagacgatgaaaatatttctcatcaagatgggtttccaggctcccctcctgcaccacagcggacacaacaaaaagatggtaaacaccctgttctgaatttaaaggatgaaaaacctccattatgtgagaaacctccaccctccccagatataactggtagagcacgtcaaagatatacagaaataaccagagaaaagtttgaggcattaaaagaagaaaatatggacctaaacaatatgaatcaaagccttacccttgaactaaacacaatgaaacaagcaatgaaagaactacagttaaaacttaagggaatggaaaaagagaagagaaagctcaaagaggctgagaaggcgtcgtcacaggaagttgctgcacctgaattactttatctgcgaaaacaagctcaagaactggtggatgaaaatgatggattgaaaatgactgtccatcgtttgaatgtagaactcagtcgatatcagacaaaattcaggcatttgtccaaggaagagagcttaaatattgaaggcctcccatccaagggccctataccaccctggttgttggatataaagtacctgtcaccattgttgctggcttatgaagatatgatgaaagagaaggacgagctcaatgccaccctcaaggcgtcagcttcagactcaagcaaaactggttttagaggaaaacaagttgttgctggagcagttggagattcagcaaaggaaagccaaggacagccaccaggagcgcctccaagaagtttctaagctgactaaacaactaatgctcctggaggcaaaaacccacggccaggaaaaggagctggcggagaacagggaacagctggagattttacgtgccaaatgccaagaactcaaaacacactcggatggcaaaatcgcagtggaagttcataaatcaattgtgaatgaattaaaaagccaattacagaaggaagaagagaaagaaagggctgagatggaggagttgatggagaagctgacagtcctgcaagcgcagaagaagagcctgctgttagagaagaacagtttgacagagcaaaacaaagcactggaagccgaacttgaacgagcacagaaaatcaataggaaatctcaaaagaaaattgaggtcctcaaaaagcaggtggaaaaagccatggggaacgaaatgtctgctcatcagtacctggcaaaccttgttggcctggcagaaaacataacccaggaacgtgacagtcttatgtgtttggcaaaatgtttagaaagtgagaaggatggagtgcttaataaagtcataaaaagcaacattcgcctgggaaagttagaggaaaaagtcaagggctacaagaagcaggcagcactgaagctgggggacatcagtcaccgtctgctggagcagcaggaggacttcgccggcaagacagcccagtaccggcaggagatgcggcacctgcaccaggtgctgaaggacaagcaggaggtgctggaccaggcgctgcagcagaacagagaaatggaaggtgaacttgaagttatttgggaatctaccttcagggaaaaccgaagaatccgagaacttctccaggacacactcacgaggacaggcgtgcaggacaaccccagagctctggttgcccccagcctcaatggcgtctctcaggcagacctgctggacggctgcgatgtctgctcctatgacctgaagtctcatgcccccacctgctagaatctgcgggagcccgtggtgtagcctcctctggcctgaaaggtctgcctcacacaggccttccctgcagggcagcccatggtggcagccggaggtgcgtaagcccactgaacgctgcagggcagggaagaaataaatggtctcatagtttaa

SEQ ID NO: 116660 - DNA, 1340 bp, Homo sapiens
  Payload ID: 2749
  Gene Symbol: CEP89
  Gene Name: centrosomal protein 89kDa
  ENST ID: ENST00000590597
  CDS Start-End: 90-1160
cctgcggcgggctttagggagtggtccctggctgtggatagatctgctgatgagtccaggccccggtccattctcctcgcgctgcaaggatgctcctgggatttcggagaggccgcaggagtcatttcaaacacatcatccatggccttttacctgcagccagcgttgctccgaaggcagctgtgccacgcacacctcctccccgcagccccaacccatctccagagagaccaagatctgctctggcagcagccattctggcgacaacattgactgggcggacggttgctattcctcagcctcgccagaggtcccggtctgagagtgatgtgagcagtgttgaacaggacagcttcatcgagccctatgccaccacctcacagctgaggcctcggccaaattggcagagtgagatgggaagaagatcttctttgccatcctttgaaacactggactatggggacgaagaggacattgaaactcagctgtcatccagcggcaaggaattgggggatgtcagtgcccgggaggacagaggaggccacagtgatgacctgtacgctgtgccacacagaaatcaggtgccattgttacatgaggtgaacagtgaagacgatgaaaatatttctcatcaagatgggtttccaggctcccctcctgcaccacagcggacacaacaaaaagatggtaaacaccctgttctgaatttaaaggatgaaaaacctccattatgtgagaaacctccaccctccccagatataactggtagagcacgtcaaagatatacagaaataaccagagaaaagtttgaggcattaaaagaagaaaatatggacctaaacaatatgaatcaaagccttacccttgaactaaacacaatgaaacaagcaatgaaagaactacagttaaaacttaagggaatggaaaaagagaagagaaagctcaaagaggctgagaaggcgtcgtcacaggaagttgctgcacctgaattactttatctgcgaaaacaagctcaagaactggtggatgaaaatgatggattgaaaatgactgtccatcgtttgaatgtagaactcagtcgatatcagacaaaattcaggcatttgtccaaggaagaggtaacgtttccgattgtgaaaatcagcttttcagatttttaagcctttactgttgaattgatttccaatcttgagaggttcttatttattataatttgatgtaagaaaagctctgtccaaggcacaatgtttctaaggaccattctgtttcttgcctccttcccttccttcttccccgtaataaaggcaataaagactgtaaaacattgggacaatacagaa

SEQ ID NO: 116661 - DNA, 2367 bp, Homo sapiens
  Payload ID: 2749
  Gene Symbol: CEP89
  Gene Name: centrosomal protein 89kDa
  ENST ID: ENST00000591698
  CDS Start-End: 1-522
gaacaggacagcttcatcgagccctatgccaccacctcacagctgaggcctcggccaaattggcagagtgagatgggaagaagatcttctttgccatcctttgaaacactggactatggggacgaagaggacattgaaactcagctgtcatccagcggcaaggaattgggggatgtcagtgcccgggaggacagaggaggccacagtgatgacctgtacgctgtgccacacagaaatcaggtgccattgttacatgaggtgaacagtgaagacgatgaaaatatttctcatcaagatgggtttccaggctcccctcctgcaccacagcggacacaacaaaaagatggtaaacaccctgttctgaatttaaaggatgaaaaacctccattatgtgagaaacctccaccctccccaggtcccacattgttacaagatctttggggtgtcgcttttctggtcggaaatgtctgtggtgccagtgtgcctttgcctgagttcttgtcctgcgtccaggaagaatgagatataactggtagagcacgtcaaagatatacagaaataaccagagaaaagtttgaggcattaaaagaagaaaatatggacctaaacaatatgaatcaaagccttacccttgaactaaacacaatgaaacaagcaatgaaagaactacagttaaaacttaagggaatggaaaaagagaagagaaagctcaaagaggctgagaaggcgtcgtcacaggaagttgctgcacctgaattactttatctgcgaaaacaagctcaagaactggtggatgaaaatgatggattgaaaatgactgtccatcgtttgaatgtagaactcagtcgatatcagacaaaattcaggcatttgtccaaggaagagagcttaaatattgaaggcctcccatccaagggccctataccaccctggttgttggatataaagtacctgtcaccattgttgctggcttatgaagatatgatgaaagagaaggacgagctcaatgccaccctcaaggaggaaatgagaatgtttaggatgcgagtccaagaagtggtgaaagaaaatgaagaattgcaccaagagttaaataagagtagtgctgttaccagtgaggaatggcgtcagcttcagactcaagcaaaactggttttagaggaaaacaagttgttgctggagcagttggagattcagcaaaggaaagccaaggacagccaccaggagcgcctccaagaagtttctaagctgactaaacaactaatgctcctggaggcaaaaacccacggccaggaaaaggagctggcggagaacagggaacagctggagattttacgtgccaaatgccaagaactcaaaacacactcggatggcaaaatcgcagtggaagttcataaatcaattgtgaatgaattaaaaagccaattacagaaggaagaagagaaagaaagggctgagatggaggagttgatggagaagctgacagtcctgcaagcgcagaagaagagcctgctgttagagaagaacagtttgacagagcaaaacaaagcactggaagccgaacttgaacgagcacagaaaatcaataggaaatctcaaaagaaaattgaggtcctcaaaaagcaggtggaaaaagccatggggaacgaaatgtctgctcatcagtacctggcaaaccttgttggcctggcagaaaacataacccaggaacgtgacagtcttatgtgtttggcaaaatgtttagaaagtgagaaggatggagtgcttaataaagtcataaaaagcaacattcgcctgggaaagttagaggaaaaagtcaagggctacaagaagcaggcagcactgaagctgggggacatcagtcaccgtctgctggagcagcaggaggacttcgccggcaagacagcccagtaccggcaggagatgcggcacctgcaccaggtgctgaaggacaagcaggaggtgctggaccaggcgctgcagcagaacagagaaatggaaggtgaacttgaagttatttgggaatctaccttcagggaaaaccgaagaatccgagaacttctccaggacacactcacgaggacaggcgtgcaggacaaccccagagctctggttgcccccagcctcaatggcgtctctcaggcagacctgctggacggctgcgatgtctgctcctatgacctgaagtctcatgcccccacctgctagaatctgcgggagcccgtggtgtagcctcctctggcctgaaaggtctgcctcacacaggccttccctgcagggcagcccatggtggcagccggaggtgcgtaagcccactgaacgctgcagggcagggaagaaataaatggtctcatagtttaatccatt

SEQ ID NO: 116662 - DNA, 682 bp, Homo sapiens
  Payload ID: 2749
  Gene Symbol: CEP89
  Gene Name: centrosomal protein 89kDa
  ENST ID: ENST00000593276
  CDS Start-End: 1-652
ggcagctgtgccacgcacacctcctccccgcagccccaacccatctccagagagaccaagatctgctctggcagcagccattctggcgacaacattgactgggcggacggttgctattcctcagcctcgccagaggtcccggtctgagagtgatgtgagcagtgttgaacaggacagcttcatcgagccctatgccaccacctcacagctgaggcctcggccaaattggcagagtgagatgggaagaagatcttctttgccatcctttgaaacactggactatggggacgaagaggacattgaaactcagctgtcatccagcggcaaggaattgggggatgtcagtgcccgggaggacagaggaggccacagtgatgacctgtacgctgtgccacacagaaatcaggtgccattgttacatgaggtgaacagtgaagacgatgaaaatatttctcatcaagatgggtttccaggctcccctcctgcaccacagcggacacaacaaaaagatggtaaacaccctgttctgaatttaaaggatgaaaaacctccattatgtgagaaacctccaccctccccaggtatttgccttttgaattatattatgattgaaaagcttgttttggagaatatccagattaattttatctgaaaataaagattacattttctttttcttgta

SEQ ID NO: 116663 - DNA, 2903 bp, Homo sapiens
  Payload ID: 2749
  Gene Symbol: CEP89
  Gene Name: centrosomal protein 89kDa
  ENST ID: ENST00000591863
  CDS Start-End: 118-360
attgcgaagagaaagcgtgagggctgggcctgcggcgggctttagggagtggtccctggctgtggatagatctgctgatgagtccaggccccggtccattctcctcgcgctgcaaggatgctcctgggatttcggagaggccgcaggagtcatttcaaacagggtctcgctctgtcgcccaggctagagtgcagtggtgcgatcatagctcactgcatcctcgaactcctgggctcaagcgatcttcccaccccagcctcccgaggagctgagactacaggcgcgcgccactactcccggctaattgttcaatatttttgtggaaacagggatcttgctatgttcctatggtggtcttgagctccttagcctcctaaagtgttggtatcacaggcgtgagccactgtgcccggcgttaacaatcttctgccccagggtcggccacagttggacaggagcaccctgcctcccctgtagcattcgtccccgtgcccggagttaactcctggacgacgtacacctgctgcactgctggatatagccattcttcatttttccctcctccacccaccatgtacaccccatcagcaagtcccatccgatatacccactacatacatctgccagctgttcccatctccacccacaccccggcctccagcatctgtctggactgctgcggcagatcctcactggtttctctgcttccactctcgcccttcccctaggtccattctccacgtagcagccaaggggattcttatatttatttattatttaatttagttttagagacagggtcttgtcctgatgcccaggctggagtacagtggcatgatcatagctcactgtggcttcaacctcttgggttcaagtgatcctcctgcctcaggctcctgagtagctgggactacaggtgtgcaccaccacacctaggtattttttatttattttattttttgcctcacactctgccaagtctcaatgcctggctaattttaaaaattattttgtagaggccacgtgaggtggctctcacctgtaatccagcactttgggaggctgaggcaggcggatcatttgaggtcaggagttcaagattagcctggccaacatggtgaaaacccatctctactaaaaatacaaaaattagcgggcgtggtggtgggcacctgtaatcccagctacacgggaggttgaggtgggataatcgcttaaacccgagaggcagaggttgcagtgagccaagattgtgccactgcactccagcctgggcgacaaagctagactctgcctcaaaaaaacataattttttttttttggtagagatggggtctgggtatgctgcccaggctggtcttaaaccttggctcaagcaatcctctcaccttggcctccagagtgttgggattacaggtgtgagccactgcatctggcttgagtttttatttaaagccccaaacattaatgagtccctgctgtgtgctgatacccacaactgacagcttatggccacacggtctgtaggatagacaagcccataaataattctgtacacaatggtaaaacaagaactgctgttgatgtgtgtaccagaagggcagtgacgtcagcctggagagttggcctgggcctggcagggagtaaggaaagaattctgggtgcagaagacagcaaataccaaggcctaaaaaagaatgaattatttgctgtttgggaaatggaagcccacgctgagtgctgaagcacagggactctgcgcaggaagaggaggggaagcaagaaatgaatttgggtccttgtgatggcagtggctgctgccatcacgctgtgtggctagggctgcacacttcatggagccggtggaagccccgtccctcatgagttgggactggagccgcaaaccgctgctgcagacccaggccttctgctctatggagcaggcaggagccccaccctcttgggcagggctacagccacccaaactgcagctgtggatccgagcctctctgctcctgggggagccgggaacaggcagaatttgcccttccagatgcagctgcagccgcgcaggcaggagccagggacaagtgggagccctgcctcttccaagttggcggggtgggagctcccaggtgcagctgtggctgcccccccaggcacaggacgagggcatctctgtagcctgcaccatcggccatcccaggaaggacagcccccttcaccctccatccctgcaggctcaggggtgtctgcttccactgcctggcctctctccactccagcaactgctctgatcttggaggggagtcggagccaagacctgcagccatgaatggcagcaggaggaagggggtggggtccccagtaaggccccaccctcaggccagggagggcctgaattctgggggctgggctgccagtccctctgaccagagtggaaactcgtggagccttttctgggcctgccaatggcccaatcagcacacacttcttccccgctgaggtccataaaaaccctgggctcagccagagcagcgcagagaatagccagaggatgaagatggtagagacgaggggacaggatgaccagctgcagagagcagtaccctctctgctgatagctggagacggtggggtgaccagctacagagaggagtaccttctccgctgaaagctacagagaccacctgccagcagagaggagctacactctgctgcgagcttcagagacctgcagagacattggaatgacttgcctgcggagaggagccactctctccagggcctcctctctgttgagagctgaatggttgagctcatgggacaatctgtctccagagaggagctacccactcctctgagctcttctaacactaaataaaactcctcttcacccttca

SEQ ID NO: 116664 - DNA, 3139 bp, Homo sapiens
  Payload ID: 2750
  Gene Symbol: CEP95
  Gene Name: centrosomal protein 95kDa
  Uniprot ID: Q96GE4
  ENST ID: ENST00000556440
  CDS Start-End: 511-2976
ctcggagatgtttacgtctccaaagagccctcacgtctgtaaccaaaagagggggaaggcggggcctggcgttgtcacgtggctgtaccaccccggaccaccgagagagcggtccgcactactttcccgttgacgtcggcggagggatacaaaacgaaatagctcaccggaagtgcgctgctcgcaccccgggacccgcccgggctgccggctgatgtggaccgtccgacccgcgtgtctgataatcctttgacgggttttggtcggcggagaatggtctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaatgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttct

SEQ ID NO: 116665 - DNA, 2492 bp, Homo sapiens
  Payload ID: 2750
  Gene Symbol: CEP95
  Gene Name: centrosomal protein 95kDa
  ENST ID: ENST00000553412
  CDS Start-End: 59-2329
caggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacagctctatattctgtctccaggagaaaatatagtgaaaggagaatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagtgggaaaaaatatacagaggagaagcttcgtaaaggaactccagaatgtagtcagccctggaagatttactctagaaaaaccacaacgcagagtcagaggtggcctcccaaagccaaataaagcagttccaatgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttct

SEQ ID NO: 116666 - DNA, 2669 bp, Homo sapiens
  Payload ID: 2750
  Gene Symbol: CEP95
  Gene Name: centrosomal protein 95kDa
  ENST ID: ENST00000553956
  CDS Start-End: 14-313
ctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacagctctatattctgtctccaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagtgggaaaaaatatacagaggagaagctgttcgtaaaggaactccagaatgtagtcagccctggaagatttactctagaaaaaccacaacgcagagtctaagaggtggcctcccaaagccaaataaagcagttccaatgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaa

SEQ ID NO: 116667 - DNA, 404 bp, Homo sapiens
  Payload ID: 2750
  Gene Symbol: CEP95
  Gene Name: centrosomal protein 95kDa
  ENST ID: ENST00000583457
  CDS Start-End: 1-404
aaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggaaaaaatatacagaggagaagctgttcgtaaaggaactccagaatgtagtcagccctggaagatttactctaga

SEQ ID NO: 116668 - DNA, 903 bp, Homo sapiens
  Payload ID: 2750
  Gene Symbol: CEP95
  Gene Name: centrosomal protein 95kDa
  ENST ID: ENST00000581056
  CDS Start-End: 88-558
agtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtaagtttaagaatggaaatttggtttggtttaccttttatgatgtgtcccttttgccttttatctttttgtgtatttttcttcataggaagcagattcactaatacagtatacctgataaccgtagttgtaaatttcaaattcttattgttccagctggttggaaactgtcttagactgtcatcatgttctttatcaacttggatgttgctcataaattacttcaaaactaatttatactagaaagataaatttctggctaaattatttattgtcctatgattgcataaaatttctttctccaaaatttcgtgtgtcagaactgctatttatggtaaatatttggatgttactgaggcatcaacaggaagaattggtgcatttgtgtctttagcctgcacttacatttgtgacagcctaaatatttcagatatttgtcattgcaaaaa

SEQ ID NO: 116669 - DNA, 607 bp, Homo sapiens
  Payload ID: 2750
  Gene Symbol: CEP95
  Gene Name: centrosomal protein 95kDa
  ENST ID: ENST00000583676
  CDS Start-End: 1-309
atatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccaggtactaccaactgagcagtcaccacggccggagaaaacgggcaccttccctgctctgcgaggagacagaaagctgagctctgcaacatgacagaggcatcaactcaggatggcatgtgttcttgaacttttcattttgtgactcatgttgtcaccctccatagagccaaccataaatgttttcaaaacgattcattacaaactcaatattctttaaaaacgttgatgctgtgacagtgcaaacagcattgattttattgctcgacttcggcatgggcacatacatagttaatttttaaaaaccatttatacagatgttactgataaagctcatgtaacaaatgaatgaaaatacaaagaatatcaaagctaaaacactctgtaataaa

SEQ ID NO: 116670 - DNA, 592 bp, Homo sapiens
  Payload ID: 2750
  Gene Symbol: CEP95
  Gene Name: centrosomal protein 95kDa
  ENST ID: ENST00000577960
  CDS Start-End: 1-223
gtgctccttgtcttctgagatgttgggcccctcttgggatggagatgaagcagaatccactggtgaaatcattagacttggagacacagcacacaccttttctctaagaagtaatggtcttgctctgtcacccagggtggagtgcggtggcgcaatctcggctcactgcaacctctgcctcagcctctcaagcggctgggattacaagtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatcc

SEQ ID NO: 116671 - DNA, 895 bp, Homo sapiens
  Payload ID: 2750
  Gene Symbol: CEP95
  Gene Name: centrosomal protein 95kDa
  ENST ID: ENST00000579860
  CDS Start-End: 234-707
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcct

SEQ ID NO: 116672 - DNA, 516 bp, Homo sapiens
  Payload ID: 2750
  Gene Symbol: CEP95
  Gene Name: centrosomal protein 95kDa
  ENST ID: ENST00000582724
  CDS Start-End: 1-214
cttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtctaatatatacttacctggcaatatttcctagagctgatcaggttcttcaaaatgccagttaacagtaatgggaaacaaatctttattatcactaatcatatcagctgtgcagggcagcttcaacctgggacctgagctagcattatcatttaccactgaagaaggaggggttcgaaggaagaccatgggttcagtgctgggttcttcctctcactatatgatggcagctctctaagcctgttttctcatctgaaattctttcatggttgttgtgaaagttaagtaagtagatgtgtgtaaacagttgggcacacagcctagctcagagtaaatgcataataaatgttaattgatgttattgaaa

SEQ ID NO: 116673 - DNA, 575 bp, Homo sapiens
  Payload ID: 2750
  Gene Symbol: CEP95
  Gene Name: centrosomal protein 95kDa
  ENST ID: ENST00000580188
  CDS Start-End: 406-575
tccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatat

SEQ ID NO: 116674 - DNA, 8361 bp, Homo sapiens
  Payload ID: 2751
  Gene Symbol: CEP97
  Gene Name: centrosomal protein 97kDa
  Uniprot ID: Q8IW35
  ENST ID: ENST00000341893
  CDS Start-End: 753-3350
actacagacggggtttctccatgttggccaggcgggtctcgaattcccgacctcaggtgatcagcctgcgttgacctcccaaagtgctgggattacagacgtgaaccactgcgcccggcctggagattatattttaaagttattttgaatactccctggaaaagttcttggttcatacttatacccgtaagtcaaaagatttgtcaaatattcaagaacaatcaaacaatcacttaaaaatactgtataaaagtttctatttcggcatactttacttttacttaactaaaatttcaaataaaatgtatccacttttatgatctcaacaagatcggtcattcctatagcggagttgaaaactttcaacttattcacaattatcaaaagaatggagcagcccccacagagacttccagcaatgagttgtaaaatgcagtctgcattaagtagcttccttacaatcatcccgatggtaaaagtgtcaaatttcgcaaacgcctggacaaggaagtgaaatgatcatctaataacgcagttgactcatctgtcaaataagcgagtgggccagggtccctgagctcactaccctcagattctaactccagcttcacatcattaggcgtaagcagccaattgggccgtctgggagccgtgcatcctgggagttatagtttccggctccctccttcagattacaagctccacagagccgcgggaggacggttgcctggtattattagcaagcagcaaatatggcggtggcgcgcgtggacgcggctttgcctcccggagaaggatcagtggtcaattggtcaggacagggactacagaaattaggtccaaatttaccctgtgaagctgatattcacactttgattctggataaaaatcagattattaaattggaaaatctggagaaatgcaaacgattaatacagttatcagtagctaataatcggctggttcggatgatgggtgtggccaagctgacgttgcttcgtgtattaaatttgcctcataatagcattggctgtgtggaagggctaaaggaactagtacatctggaatggctgaatttggcaggaaataatcttaaggccatggaacagatcaatagctgcacagctctacagcatctcgatttatcagacaataatatatcccagataggtgatctatctaaattggtatccctgaaaaccctgcttttacatggaaacatcatcacctctcttagaatggcacctgcttacctacccagaagtcttgctatactttctttggcagaaaatgaaatccgagacttaaatgagatctcttttttggcatccttaactgaattggaacagttgtcgattatgaacaatccttgtgtgatggcaacaccatccatcccaggatttgactatcggccgtacatcgtcagctggtgcctaaacctcagagtcctagatggatatgtgatttctcagaaggaaagtttgaaagctgaatggctctatagtcaaggcaaggggagagcatatcggcctggccagcacatccagcttgtccaatatctggctacagtctgccccctcacttctacactaggtcttcaaactgcagaggatgccaaactagagaagattttgagcaaacagaggtttcaccagaggcagttgatgaaccaaagccaaaatgaagagttgtctcctcttgttcctgttgaaacaagggcatcccttattcctgagcattcaagccctgttcaagattgccagatatcccaggaaagtgaacccgtcattcaagtgaattcttgggttgggataaacagtaatgatgatcagttatttgcggttaagaataattttccagcctctgtacacactacgagatattctcgaaatgatctgcacctggaagacatacagacggatgaggacaagttaaactgtagtcttctctcttcagagtctacttttatgccagttgcatcaggactgtctccactatcacctacagttgagctgaggctgcagggcattaacttgggcctagaagatgatggtgttgcagatgaatctgtgaaagggctggaaagccaggtgttggataaggaagaggaacagcctttatgggctgcaaatgagaattctgttcaaatgatgagaagtgaaatcaatacagaggtaaatgagaaagctggactattaccttgtcctgagccaacaataatcagtgctatcttgaaggatgataaccacagtcttacattttttcctgagtcaactgagcagaaacaatcagacataaagaaaccagaaaatacacaaccagaaaataaagaaaccatatctcaagcaacttcagagaaacttcccatgattttaacccagagatctgttgctttgggacaagacaaagttgcccttcagaaattaaatgatgcagccaccaagcttcaggcctgttggcggggattttatgccaggaactacaaccctcaagccaaagatgtgcgttacgaaatccggctacgcagaatgcaagagcacattgtctgcttaactgatgaaataaggagattacgaaaagaaagagatgaagaacgtattaaaaaatttgtacaagaagaagctttcagattcctttggaaccaggtaaggtctctacaggtttggcaacagacagtggaccagcgtctaagttcctggcatactgatgttcctcctatatcaagtactcttgtgccatcgaaacatccattatttacccaaagccaggagtcctcttgtgatcaaaatgctgattggtttattgcttctgatgtagctcctcaagagaaatcattaccagaatttccagactctggttttcattcctctctaacagaacaagttcattcattgcagcattctttggattttgagaaaagttccacagaaggcagtgaaagctccataatggggaattccattgacacagtcagatatggcaaagaatcagatttaggggatgttagtgaagaacatggtgaatggaataaggaaagctcaaataacgagcaggacaatagtctgcttgaacagtatttaacttcagttcaacagctggaagatgctgatgagaggaccaattttgatacagagacaagagatagcaaacttcacattgcttgtttcccagtacagttagatacattgtctgacggtgcttctgtagatgagagtcatggcatatctcctcctttgcaaggtgaaattagccagacacaagagaattctaaattaaatgcagaagttcaggggcagcagccagaatgtgattctacatttcagctattgcatgttggtgttactgtgtagcatgtcttttgggaggcagatatccacttaacttttcttaaaaatactttcagttgcctttgcttttttttggagggaaatactccctacccctaattttgttactacttatatagaatttgtattcatgtcttatatttttcagattctagatattgagctgagttttcattttgattttgttagctttttacttagctgtaaggtaccaaactatttatattgaaagctatatgcactttatttcttaactgaattgcatcaacaatgttcctgtttctttcatgtactcatttactttcaaaaataagctagaatatattaaagaaaatagaaaaaattaccttaaatatataaataagagaattttggcccttctgtgtctgagaaaattaattatatagcaaggaatgaaatttgataaagcaaatataaatgagaaatatgaggattgtgaattattgaaatttgccagtctccctggtgtaaaatgtttttttaaagccttttttcctcctttcggagtcaaggaaagcctttctataagcaaattaaggaagaaaaggtaggattataagatttctcaatggggatgattaaattgtctcatggaaaacttcagttaatgtcatgcatcagttttaacatatgaagtaaagtgttctatccaggattaaagtcaagtttacttaggcaacacaagaatatttcacttagatatgaagaaaggaaacactagtctccattcacttgaaatactctcatggcaaatatttatcctctcattaagtgctttttcaccctataggtaagcatttttgtgccaacatgttgtcagaaattaatgtatgttcatctcctctgttcctgcttatttttacttatatatttcagcagaaggtccgtggccattcacttcaattttgacctctgtcccatagtgaagaacatttaaagtaatactactggtcgaatatgaatgactttttaggaactactttttgtctaacctgaaaaagttccacatttggaagacaatttaatgatggtgaagaaataataaacctcactttacttgttaaaagggatatatatatatatatatatgtctgcaacttcagggagaaataagattgtgtttgaatattgtaggtagatgcatttgtaattaaggataatatcgtttaacaacatgtatttggtttccctcaacttacagacatacagctatttaaaactatggcaatacttaagcatctctaaatttaggtgctaaatatctattattctgttgtagtcattaggtgcccttctctgaagttatgtaaaataaaagcatctgatccttcaaggataaagttgaggatcacatggtacgtggcatttgttgttattgttttttaaagagatggaggctggctctgttggtgcggtgccatgatcatagttcactataacctcgaactcctggctcaagtgatctcccacttcagcctcccgagtatctgggattataagcaagagccactgctcccagctcatggtatttgttgatagtcataacatttttcctgtatggtaagacgtatttttctcagtttataaatacgtagcactcaggttgagacgacttggattttattcttagaaatccagaatcccttgaaaaggaaatattttctgtttcttataaataaaagagtaatcttactttcagaaggattttccttagtgaaacatgtgtaacattgaatgcatgttaaataaaaatggaatttctaactttttttcaatagtgctaattatcttttctgaatgattttgaatgtcttcttaaatataccctatttttctattttaaagttaagtgcctcacttgctgtccatagttagacaaagaaaaaccaatttccactgcactagtaccaaaatactactttatacattagtttttcataaaagctgctggaatgtcatgattcagtattacctaaatagatttctgctaaaatcctctccctcctgtcttttttaagttatggaaaaacacaactaaattcatttgatcatcagcacttgttagcaggatttccttttttacctttgccttgtttctttagcccacaaatagtactcagcatactttcattaaaaatttggcacaatatgataattgttaatattctgttcttcgtctgtgttttatttaacttttactagtgtttagaagtgcaagaatattaaatagccccttccttaactgtacatattatcttgaatgtagataaaatgaaaatactgtaaattagagtgtaggaaaactggcatagagttaatatattttaatgggtttacattatactttaaaagtaatttatataattaaaatatttggttttaactctatgggctattctttggttggctgaagagggaatgggtctagtaaggtttggaaagttaagctttgaacatggtctttgtgtttttttcctaacaaggaaaggtttagttcagctgtgctattttagtacacatcagttctcttgatttatggaagattcagtttatcaattaagaattcctgcagaagcacagaatcataccatgtaagagttggaaggaagcttaagagatttctgttcgaatctctttgtttcaaagatgaaactaaagcacagcatgttaaatgacttgtctaagttatagctagttagtagtaaataaactgaaaacctatatgctactgtagtccaaaattttattatgtcctcttaatctttacatttagtgagtcagtaaggaaatctctgcatatttctcattctctttgaaagaggaaaaaaacttctaagagagctacaactctatcactcatgacagagttgcttgtagaaaataactaattccttcagaaccctgagtgaattttttctaagaaatgtgacttgattaaaatggtttcaaaagagcaatagtggaaattaaagttttagaaaagagacctggcgtggtggttgacaactgtaatcccagtgctttgggaggctgaggccagaggatcacttgaggccaggagttcaagaccagcctggacaacatagcaagacccccctctctacaaaaaaaatttttttctgaaaagaataagtacattttagagtccatttatttgacgacaggcagtatgacaggttgctgaggtatataaaattttctagagaaatgctgagtttgatgacattttatcttcagttttgtagaacagatgttaaaatgttaactctcctggtgtgcagaaagctgtaatcatgacagttgataatatgcaatttagtttgattttataggtttaattataaaaggcttcacaatatgcatgttttaggaaaatgttcatttatttagtcatataatcgtttgtatatatgtaaataactttattctggaataatgtgggtgccatcttgagcgtgtgtttttatctgttttggattattttttgtatacaaacaccataatactgtattttcctgttatctacttaagtctagttctactttttcccaataatttcaggaaaatacaagcttgagatattatactatctcccttggtattttttgtgtgcaaagtcttagaattggatttataacattgataataaaaatataaaacgtttttcctcgggagttaagatggtaaaaagaaaaaaatagaatgaatatgatcatttctccatcataaaggaaagaagagacttcattgtgtgtgtgttttttttttttttttcgagatagagtttcactgttgtcacccaggctggtctcagctcactgcaacctccacttcctgggtacaagcgattctcctgcctcagcttcctgtgtagctgggattacaggtgtgcaaccacaaggctcggctaatttttttgtatttttagtagagatggggtttcaccatgttggccaggctggtctcgaactcctgacctcaagtgatccacccacctcggcctcgcaaagtgctgagattacaggtgtgagccactgtgcccagccgagacttcattgtttaatgtatatttttattttttccaaacaccagctcgaatcagagtatatttttattttgccacatacctttaaaaggtatttattgtgtcataatgttttaaatgttaaatatatgataccctcattcatgaagtgaagcagaaagggtctgtaaggaacattctaaacatttttaatgatattgcttttactgatcaagcttgttgtgccatattaaaattaaaagtcaaataaacaaagcagtcctcacagccttggaaagaaatagataattgtcttcttaagatgaggtgctttttatctgtggatgaatggaaatcacactgaattttaattcttatttattttagtggatagcaggaatcactctgtagtagttgtgttcattttcttttctttttcttttcttttttttgagagagtctcgctctgtcaccaggctggagtgcagtggcgtgatctcggctcactgcaacctccatctcctgggttcaagtgattctcctgcctcatcctcccgagtagctaagactacaggcacacgccaccatgcccagctaatttttatatttttagtagagatggggtttcaccatgttggccaggatggtctcaatctcttgacctcgtgatccacccagtttggcctcccaaagtgctgggattacaggcgtgagccactacacctggccttgttcatcttctaattaaatatctttgaatgttttgtaataattttaatgttgacaataagagtttaaaaataatttgattttggactgtatttagatttctctttaattttgctgtagaaatagtaaatgatttaaagtggttatgatgtgttttatgaaggcttactattttatattgtacttatttaatttgtatttgagtctgtctaattttaaataaaaggtttatacatttga

SEQ ID NO: 116675 - DNA, 2870 bp, Homo sapiens
  Payload ID: 2751
  Gene Symbol: CEP97
  Gene Name: centrosomal protein 97kDa
  ENST ID: ENST00000494050
  CDS Start-End: 23-2443
gtattattagcaagcagcaaatatggcggtggcgcgcgtggacgcggctttgcctcccggagaaggatcagtggtcaattggtcaggacagggactacagaaattaggtccaaatttaccctgtgaagctgatattcacactttgattctggataaaaatcagattattaaattggaaaatctggagaaatgcaaacgattaatacagttatcagtagctaataatcggctggttcggatgatgggtgtggccaagctgacgttgcttcgtgtattaaatttgcctcataatagcattggctgtgtggaagggctaaaggaactagtacatctggaatggctgaatttggcaggaaataatcttaaggccatggaacagatcaatagctgcacagctctacagcatctcgatttatcagacaataatatatcccagataggtgatctatctaaattggtatccctgaaaaccctgcttttacatggaaacatcatcacctctcttagaatggcacctgcttacctacccagaagtcttgctatactttctttggcagaaaatgaaatccgagacttaaatgagatctcttttttggcatccttaactgaattggaacagttgtcgattatgaacaatccttgtgtgatggcaacaccatccatcccaggatttgactatcggccgtacatcgtcagctggtgcctaaacctcagagtcctagatggatatgtgatttctcagaaggaaagtttgaaagctgaatggctctatagtcaaggcaaggggagagcatatcggcctggccagcacatccagcttgtccaatatctggctacagtctgccccctcacttctacactaggtcttcaaactgcagaggatgccaaactagagaagattttgagcaaacagaggtttcaccagaggcagttgatgaaccaaagccaaaatgaagagttgtctcctcttgttcctgttgaaacaagggcatcccttattcctgagcattcaagccctgttcaagattgccagatatcccaggaaagtgagtctacttttatgccagttgcatcaggactgtctccactatcacctacagttgagctgaggctgcagggcattaacttgggcctagaagatgatggtgttgcagatgaatctgtgaaagggctggaaagccaggtgttggataaggaagaggaacagcctttatgggctgcaaatgagaattctgttcaaatgatgagaagtgaaatcaatacagaggtaaatgagaaagctggactattaccttgtcctgagccaacaataatcagtgctatcttgaaggatgataaccacagtcttacattttttcctgagtcaactgagcagaaacaatcagacataaagaaaccagaaaatacacaaccagaaaataaagaaaccatatctcaagcaacttcagagaaacttcccatgattttaacccagagatctgttgctttgggacaagacaaagttgcccttcagaaattaaatgatgcagccaccaagcttcaggcctgttggcggggattttatgccaggaactacaaccctcaagccaaagatgtgcgttacgaaatccggctacgcagaatgcaagagcacattgtctgcttaactgatgaaataaggagattacgaaaagaaagagatgaagaacgtattaaaaaatttgtacaagaagaagctttcagattcctttggaaccaggtaaggtctctacaggtttggcaacagacagtggaccagcgtctaagttcctggcatactgatgttcctcctatatcaagtactcttgtgccatcgaaacatccattatttacccaaagccaggagtcctcttgtgatcaaaatgctgattggtttattgcttctgatgtagctcctcaagagaaatcattaccagaatttccagactctggttttcattcctctctaacagaacaagttcattcattgcagcattctttggattttgagaaaagttccacagaaggcagtgaaagctccataatggggaattccattgacacagtcagatatggcaaagaatcagatttaggggatgttagtgaagaacatggtgaatggaataaggaaagctcaaataacgagcaggacaatagtctgcttgaacagtatttaacttcagttcaacagctggaagatgctgatgagaggaccaattttgatacagagacaagagatagcaaacttcacattgcttgtttcccagtacagttagatacattgtctgacggtgcttctgtagatgagagtcatggcatatctcctcctttgcaaggtgaaattagccagacacaagagaattctaaattaaatgcagaagttcaggggcagcagccagaatgtgattctacatttcagctattgcatgttggtgttactgtgtagcatgtcttttgggaggcagatatccacttaacttttcttaaaaatactttcagttgcctttgcttttttttggagggaaatactccctacccctaattttgttactacttatatagaatttgtattcatgtcttatatttttcagattctagatattgagctgagttttcattttgattttgttagctttttacttagctgtaaggtaccaaactatttatattgaaagctatatgcactttatttcttaactgaattgcatcaacaatgttcctgtttctttcatgtactcatttactttcaaaaataagctagaatatattaaagaaaatagaaaaaattaccttaaatatataaataagagaattttggcccttctgtgtctgagaaaattaattatatagcaaggaatgaaatttgataaagc

SEQ ID NO: 116676 - DNA, 1782 bp, Homo sapiens
  Payload ID: 2751
  Gene Symbol: CEP97
  Gene Name: centrosomal protein 97kDa
  ENST ID: ENST00000467655
  CDS Start-End: 1-528
attggctgtgtggaagggctaaaggaactagtacatctggaatggctgaatttggcaggaaataatcttaagaccctgcttttacatggaaacatcatcacctctcttagaatggcacctgcttacctacccagaagtcttgctatactttctttggcagaaaatgaaatccgagacttaaatgagatctcttttttggcatccttaactgaattggaacagttgtcgattatgaacaatccttgtgtgatggcaacaccatccatcccaggatttgactatcggccgtacatcgtcagctggtgcctaaacctcagagtcctagatggatatgtgatttctcagaaggaaagtttgaaagctgaatggctctatagtcaaggcaaggggagagcatatcggcctggccagcacatccagcttgtccaatatctggctacagtctgccccctcacttctacactaggtcttcaaactgcagaggatgccaaactagagaagattttgagcaaacagagaggcagttgatgaaccaaagccaaaatgaagagttgtctcctcttgttcctgttgaaacaagggcatcccttattcctgagcattcaagccctgttcaagattgccagatatcccaggaaagtgaacccgtcattcaagtgaattcttgggttgggataaacagtaatgatgatcagttatttgcggttaagaataattttccagcctctgtacacactacgagatattctcgaaatgatctgcacctggaagacatacagacggatgaggacaagttaaactgtagtcttctctcttcagagtctacttttatgccagttgcatcaggactgtctccactatcacctacagttgagctgaggctgcagggcattaacttgggcctagaagatgatggtgttgcagatgaatctgtgaaagggctggaaagccaggtgttggataaggaagaggaacagcctttatgggctgcaaatgagaattctgttcaaatgatgagaagtgaaatcaatacagaggtaaatgagaaagctggactattaccttgtcctgagccaacaataatcagtgctatcttgaaggatgataaccacagtcttacattttttcctgagtcaactgagcagaaacaatcagacataaagaaaccagaaaatacacaaccagaaaataaagaaaccatatctcaagcaacttcagagaaacttcccatgattttaacccagagatctgttgctttgggacaagacaaagttgcccttcagaaattaaatgatgcagccaccaagcttcaggcctgttggcggggattttatgccaggaactacaaccctcaagccaaagatgtgcgttacgaaatccggctacgcagaatgcaagagcacattgtctgcttaactgatgaaataaggagattacgaaaagaaagagatgaagaacgtattaaaaaatttgtacaagaagaagctttcagattcctttggaaccagaaatggggtcttgccatattgcccaggccggtctcaaacttctgggctcaagcagtcttccctcctcagcctcccaaagtaaggtctctacaggtttggcaacagacagtggaccagcgtctaagttcctggcatactgatgttcctcctatatcaagtactcttgtgccatcgaaacatccattatttacccaaagccaggagtcctcttgtgatcaaaatgctgattggtttattgcttctgatgtagctcctcaagagaaatcattaccag

SEQ ID NO: 116677 - DNA, 769 bp, Homo sapiens
  Payload ID: 2751
  Gene Symbol: CEP97
  Gene Name: centrosomal protein 97kDa
  ENST ID: ENST00000465011
  CDS Start-End: 20-406
ttattagcaagcagcaaatatggcggtggcgcgcgtggacgcggctttgcctcccggagaaggatcagtggtcaattggtcaggacagggactacagaaattaggtccaaatttaccctgtgaagctgatattcacactttgattctggataaaaatcagattattaaattggaaaatctggagaaatgcaaacgattaatacagttatcagtagctaataatcggctggttcggatgatgggtgtggccaagctgacgttgcttcgtgtattaaatttgcctcataatagcattggctgtgtggaagggctaaaggaactagtacatctggaatggctgaatttggcaggaaataatcttaagtgtgatgcttttcttgtgataggccatggaacagatcaatagctgcacagctctacagcatctcgatttatcagacaataatatatcccagataggtgatctatctaaattggtatccctgaaaaccctgcttttacatggaaacatcatcacctctcttagaatggcacctgcttacctacccagaagtcttgctatactttctttggcagaaaatgaaatccgagacttaaatgagatctcttttttggcatccttaactgaattggaacagttgtcgattatgaacaatccttgtgtgatggcaacaccatccatcccaggatttgactatcggccgtacatcgtcagctggtgcctaaacctcagagtcctagatggatatgtgatttctcagaaggaaag

SEQ ID NO: 116678 - DNA, 4367 bp, Homo sapiens
  Payload ID: 2752
  Gene Symbol: CSPP1
  Gene Name: centrosome and spindle pole associated protein 1
  Uniprot ID: Q1MSJ5
  ENST ID: ENST00000262210
  CDS Start-End: 32-3697
gaggggcggagccccggcccggaggtctgtcatgctgttcccgctccaggtggccgctgtaacctcttcggtccgcgacgatcctctagagcactgtgtgtctccccggacgcgagcccgctcccctgaaatctgcaaaatggctgataatttggatgaatttattgaagagcaaaaagccagattggccgaagacaaagcagagttggaaagtgatccaccttacatggaaatgaagggaaagttgtcagcgaagctttctgaaaacagtaagatactgatctctatggctaaggaaaacataccaccaaatagtcaacagaccaggggttccttaggaattgattatggattaagtttaccacttggagaagactatgaacggaagaaacataaattaaaagaagaattgcggcaagattacagacgttatcttactcaggaaaggttgaaacttgaacgtaacaaagaatacaatcagtttctcaggggtaaggaagaatccagtgaaaagttcaggcaggtggaaaagagtactgagcccaagagtcagagaaataaaaaacctattggtcaagttaagcctgatctaacttcacaaatacagacatcttgtgaaaattcagagggtcctagaaaagatgtcttaactccttcagaggcatatgaagaacttctgaaccaaagacgactagaggaggacagataccgacaactagatgatgaaatcgaattaaggaatagaagaattattaaaaaagcaaatgaagaagtgggcatttccaacctaaaacatcaaaggtttgcaagcaaggctggcattccagatagaagatttcacagatttaatgaggatcgtgtttttgatagacggtatcatagaccagaccaagatcctgaagtaagtgaagaaatggatgagaggtttagatatgaaagtgattttgatagaagactttcgagagtgtatacaaatgacaggatgcacaggaacaaacgagggaatatgcctcctatggaacatgatggggatgttatagaacagtcaaacataagaatttcatctgctgaaaataaaagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataactgatttgaataggatgcacagacaaaatatagatgcctaccataacccagatgcaagaacatatgaagataaaagggctgttgtatctctagacccaaatttagccacttcaaatgctgagaacctagaagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggtaaatctgtacctttaatatgtcctacttttggcccctacctgaaagttactttttttccatcatctgtatataaaattatttttatcatgatgtatattatgtacataaataaaaggccatgattattgatttatataatagaattgtatagattatttttgcacagttttgtcataaattagggtggtaatgaactggattgaactactatatgtgcattatattgaattctgcttgtcattaagataaggtgaataagtgtcttaaacgtcctgtaaaaccggactcccctttgttacatgcacattttccattgttacctcgatgcaaaagaattcatttagtaggtacatctattgtagctgtgattattccagtttctgtgtgatgcaatcaaatgtcctattaattaattattatttcatgtcatttgtagctactgatacagcagaaatgaagggaactgtaattacttgtatttttgtaagccatacgttaaatgtttgttacatcatctttctgcttctatttttatgccaatgaaggcatttgtcttgttactaattacatgatgtaactacttcttgatataaataaatttttattttaattactaaaa

SEQ ID NO: 116679 - DNA, 3982 bp, Homo sapiens
  Payload ID: 2752
  Gene Symbol: CSPP1
  Gene Name: centrosome and spindle pole associated protein 1
  ENST ID: ENST00000519163
  CDS Start-End: 80-1294
aacctcttcggtccgcgacgatcctctagagcactgtgtgtctccccggacgcgagcccgctcccctgaaatctgcaaaatggctgataatttggatgaatttattgaagagcaaaaagccagattggccgaagacaaagcagagttggaaagtgatccaccttacatggaaatgaagggaaagttgtcagcgaagctttctgaaaacagtaagatactgatctctatggctaaggaaaacataccaccaaatagtcaacagaccaggggttccttaggaattgattatggattaagtttaccacttggagaagactatgaacggaagaaacataaattaaaagaagaattgcggcaagattacagacgttatcttactcagggcattacacaagggaaaagaaagaaaaattttctatctacgagtgaaacagatccatctactttgggagtttctcttcctattggtgagaggttatctgctaaggaaaggttgaaacttgaacgtaacaaagaatacaatcagtttctcaggggtaaggaagaatccagtgaaaagttcaggcaggtggaaaagagtactgagcccaagagtcagagaaataaaaaacctattggtcaagttaagcctgatctaacttcacaaatacagacatcttgtgaaaattcagagggtcctagaaaagatgtcttaactccttcagaggcatatgaagaacttctgaaccaaagacgactagaggaggacagataccgacaactagatgatgaaatcgaattaaggaatagaagaattattaaaaaagcaaatgaagaagtgggcatttccaacctaaaacatcaaaggtttgcaagcaaggctggcattccagatagaagatttcacagatttaatgaggatcgtgtttttgatagacggtatcatagaccagaccaagatcctgaagtaagtgaagaaatggatgagaggtttagatatgaaagtgattttgatagaagactttcgagagtgtatacaaatgacaggatgcacaggaacaaacgagggaatatgcctcctatggaacatgatggggatgttatagaacagtcaaacataagaatttcatctgctgaaaataaaagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacggtaatgaaagagaaaaagatttagaactcagggttgcagcgtctggagcacaagaccctgagaaatcggtaagggtttctggcatcttttaatgtttaatctttcatcaaatgatcctcaaatgtggtggcaggtggggatagagaatattgggagaaaaagagagtagaccaatttgaacagtaataaaattaactaaattcagttctcataaagtgtaaattctcttaactgttatttccttgaggtaatttttcctttttcatttgtgtgtcatttttttaaagtttaaattagttctctctgctttattcacatgtactattccatgggaaagttatctgggttaaatttacaattgatgttaatatttttcttgaatacatcttgatcacttacttttcttacattggagtgatttctgagaaaactgacgactttatttttaaagcgttttagtaattgttacttattgtaacattagagagataataatcttatttttactttaattttgcaattctcatcattaagtggaatgaattactcacatcattgcagttaagtaaggaggaggtaatttattgtttttaccacaatttattttttctgtagttggttatgtaatatttatttctaatacaagtcttgtttcatctttgaatgatgattaagacctttaatttcattaaaaagctcattcttaaaaaggatgcagcaacttaaaattatttacctgtaggcaacttttgatttgcttttacttatgctgagaatatatcctgtgggttatctatttggaaaagtttcatattgcaccagcatcactcgcagtatgcttctgggttaacctgataaatcattcctgataagataaccatggtaggaaaaaaagaagataaatttcaaagctaaatatattttcctttatgaatcaaaagtttccttttaagaggtgagctttttaatgtaatatgttggcatgttaaattttgtatttatggttacactagtgtgtgacagaccttatttatctttgaattgaagctcctatacagtgtcaagttgatttatgagaataaataagtaattggaggcaacagttacgcctttacttttgggtttacttttgatgtgcaaatcttagaaaagggcacataagtgatgttctaaagtagagattagcaaagtgtggcctgtgaccaaatttgtttgctacctgttttcataaaaaaaagttttattgcagcacagccttgttcattccttgacatactgtttgtggctgctttagcaccatagctgagtctgctcattatgaagagactatgtagtcttgcaaatcttaatctatttactgtctagccctttacagaaagcatttgctgaccctgttttacagaatactataacagaaatggcaattagagaagtagcacggtgtcctagtacataaaaagaatactacagcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtggtctccctgtgttgcccagtgtgatcttgaactcctggcctcaagcgatcctcttgcctcagcctcccaaagaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataactgatttgaataggatgcacagacaaaatatagatgcctaccataacccagatgcaagaacatatgaagataaaagggctgttgtatctctagacccaaatttagccacttcaaatgctgagaacctagaagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagac

SEQ ID NO: 116680 - DNA, 569 bp, Homo sapiens
  Payload ID: 2752
  Gene Symbol: CSPP1
  Gene Name: centrosome and spindle pole associated protein 1
  ENST ID: ENST00000519701
  CDS Start-End: 82-282
gtaacctcttcggtccgcgacgatcctctagagcactgtgtgtctccccggacgcgagcccgctcccctgaaatctgcaaaatggctgataatttggatgaatttattgaagagcaaaaagccagattggccgaagacaaagcagagttggaaagtgatccaccttacatggaaatgaagaatctcgctctgttggccaggcaggactgcaatggtgtgatctcagctcgccacaacctccgcctcccaggctcaagtgattcttctgcctcagcctcatgagtagctgggactacagggaaagttgtcagcgaagctttctgaaaacagtaagatactgatctctatggctaaggaaaacataccaccaaatagtcaacagaccaggggttccttaggaattgattatggattaagtttaccacttggagaagactatgaacggaagaaacataaattaaaagaagaattgcggcaagattacagacgttatcttactcagaaaaattttctatctacgagtgaaacagatccatctactttgggagtttctcttcctattggtgaga

SEQ ID NO: 116681 - DNA, 567 bp, Homo sapiens
  Payload ID: 2752
  Gene Symbol: CSPP1
  Gene Name: centrosome and spindle pole associated protein 1
  ENST ID: ENST00000521919
  CDS Start-End: 106-567
agctggagccttaagagcgggatgtggagggcggaaagtgtttttgtgtgggtataggtaccttaaatgagataagtttgttgaaagactaaaagaatctgcaaaatggctgataatttggatgaatttattgaagagcaaaaagccagattggccgaagacaaagcagagttggaaagtgatccaccttacatggaaatgaagggaaagttgtcagcgaagctttctgaaaacagtaagatactgatctctatggctaaggaaaacataccaccaaatagtcaacagaccaggggttccttaggaattgattatggattaagtttaccacttggagaagactatgaacggaagaaacataaattaaaagaagaattgcggcaagattacagacgttatcttactcagaaaaattttctatctacgagtgaaacagatccatctactttgggagtttctcttcctattggtgagaggttatctgctaaggaaaggttgaaacttgaacgtaacaaagaatacaatcagtttctcaggggtaaggaagaatccagtgaaaagttcagg

SEQ ID NO: 116682 - DNA, 3715 bp, Homo sapiens
  Payload ID: 2752
  Gene Symbol: CSPP1
  Gene Name: centrosome and spindle pole associated protein 1
  Uniprot ID: Q1MSJ5
  ENST ID: ENST00000519668
  CDS Start-End: 1067-3697
cagtcagaccgctaacaggagaaatggaatattaagtatagtatattgttccccctcaccttttctcatttcttcctctgtctcaggcactcattcatatattcatttgcagatttattcaatgaacattttcttgggttaaagttatgtgccagcattataaaattgaatagcgcatgggccttgccttcatagattttatagtttagttttatatatgatgttccattctgaacatgagaatcaaaactttctctccttaggcttaaattctgtatctttaaaaaaaggtttagattccttcaaaaggaaacagttcctttctaggatgatttaaaattccaagcatatggaatgctttagtttcttttggaagagagttagaagcatgtgtaagaggtgtccctaaggaatcctctgttataccctctatcatcaaggagttaaataggccagaaatgtttatcaagagaattccagtgttgatagcggaattgattatggattaagtttaccacttggagaagactatgaacggaagaaacataaattaaaagaagaattgcggcaagattacagacgttatcttactcaggaaaggttgaaacttgaacgtaacaaagaatacaatcagtttctcaggggtaaggaagaatccagtgaaaagttcaggcaggtggaaaagagtactgagcccaagagtcagagaaataaaaaacctattggtcaagttaagcctgatctaacttcacaaatacagacatcttgtgaaaattcagagggtcctagaaaagatgtcttaactccttcagaggcatatgaagaacttctgaaccaaagacgactagaggaggacagataccgacaactagatgatgaaatcgaattaaggaatagaagaattattaaaaaagcaaatgaagaagtgggcatttccaacctaaaacatcaaaggtttgcaagcaaggctggcattccagatagaagatttcacagatttaatgaggatcgtgtttttgatagacggtatcatagaccagaccaagatcctgaagtaagtgaagaaatggatgagaggtttagatatgaaagtgattttgatagaagactttcgagagtgtatacaaatgacaggatgcacaggaacaaacgagggaatatgcctcctatggaacatgatggggatgttatagaacagtcaaacataagaatttcatctgctgaaaataaaagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataagtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggac

SEQ ID NO: 116683 - DNA, 2090 bp, Homo sapiens
  Payload ID: 2753
  Gene Symbol: CEP295NL
  Gene Name: CEP295 N-terminal like
  Uniprot ID: Q96MC4
  ENST ID: ENST00000322630
  CDS Start-End: 167-2032
atgagtagccagccagggcagaggccgggctgcaggtggaggcggggaagcgattccggccacctttgtgatgggcgtctcactacctacaaagtcagcccagtgatttcaagacagccctggagacagtgcttcctgccctcctgtcagcttctgcctccctgtaatgtgttctgggtggtctagctcagtcatctggagacacacacagtttgctgtggaacgttgtggcttctgtggctcctcaggcccgggggcgccccttgaaccctccactcttggctccaagcaccttccctgggaagctgtatctgctgggttcgcagacaggaacagaaacatggatggagccatgtggctgagcctctgtcctgataacgaagacctgctttggaggaaaaagcacaaattgctacaagcccggggcaaaggcgatctcgctctgcagagaagagcggatgccaagctgtggaaaaactaccagctccagcgcttggctgaggagttgaggagagggtatcaggaggcacagcacctgcacgtcggtggcctggacaggctgcagtcagcacgtctgttgggctggggaggaggacgggccagggaaaatgagcctgactcgcaggggcccatccagcgaagatcagccaggcccccgagggccaaggagaagcatagagcagcccttagtgaagagaggagttgcagggaagagttgggccagcaacaccccaggcactccaggccccggaagacagcagcgagtccagagaaaccacagactacaaaagccacgggtcggatgaattctcacctggccccgcctgagaagagaaagggaaggccagaaccttcgaccaagtctgggggtggccgctgtgccatccatcctcggaggagcaaaggggcggacctagaaaggtcaaacccactcgtggctgctgtgggagaaatcgggcttgtggaggaaaaagagaaaggaacagctcgggcggggaggaggcaactgggaaagggggcagtttgctttgttccagccctgaccagtcgctctcagggacagagtctggaggggaagctgagagacctcgggcagctgtggccagctgattccagctgcagaagggaagccgtgtccccagcatctcagtgcacgctccgggagaagaacaagtggcagaaagagctggagttggcctttgaagagttgtttaatataaacagaaagctgaaaaaacacctgtgcttgtacctggcactgaagcccaggatggaccagagacctggggaagggcatgccttctcagagatgcaagagtgtggcgctgggaccccaagagggaagaaaatggcagacccagagatgctgcctgccggggaacccaggagcccagcagaggaggaggcgcagcaggcagcgtccaagaccgacttgaaaacgttcatgggcaaggcccagaaccaaaaatatcagggcacggtcaagcccacgtttagaaatggaagtcaaacattgtctcccgaggcaggtatatttatcaacaaagaggactcattattgtatagcactgaatctggacaagagacccccaaactgggcacgctggcagagggctcccttcagctccaccttcaagaccaggcagacagagtgggctcgacggcatccaggcaaaggcagaaagcagagatggagcagagaagacaaaaacaactggaatcgcttgaacaaatggaacacccagatatgagcttggaaatccactacaaagctgagctagaaaaagagaggagggagcaaagaagagctcgactggcccatctgaagtcctcctccacgagagcccaggaaagggagagaggatctgagctcagcaccacttccccatcgggcaccagcctcgccgacgacgaccggcacagtcagatgatccgagaccagcagcagcagatcttacagcaaaacaggttgcacaagcagtttcttgaagaagcccggaaatgcttgcgggagtttcagaacatatgctaaatgcgagaggcccacccggggtaaatacatcactgataatggtgctgccagcactggt

SEQ ID NO: 116684 - DNA, 711 bp, Homo sapiens
  Payload ID: 2753
  Gene Symbol: CEP295NL
  Gene Name: CEP295 N-terminal like
  ENST ID: ENST00000586713
  CDS Start-End: 615-711
ggcaacagcctgctatgagtagccagccagggcagaggccgggctgcaggtggaggcggggaagcgattccggccacctttgtgatgggcgtctcactacctacaaagtcagcccagtgatttcaagacagccctggagacagtgcttcctgccctcctgtcagcttctgcctccctgtaatgtgttctgggtggtctagctcagtcatctggagacacacacaagcacaggcacttcgtagctgttgaccatcatttagctccacgtctgcccgtcggttcctcgtgcgtggaatccagcaccacgtgggtgtctctgccgagctctcggcatttcctgagccctcccggaagccagactctgttctcggcgcttcacacgggccgtctcgtctgatgctgtggcgtcctgcagggtgggaacgggcggtgcccgtggacgtggcgctgtgcctgccggcgtcctgggcaccacagcgttgccgcttgcccactgcctcctagcatggccagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaat

SEQ ID NO: 116685 - DNA, 1866 bp, Homo sapiens
  Payload ID: 2753
  Gene Symbol: CEP295NL
  Gene Name: CEP295 N-terminal like
  Uniprot ID: Q96MC4
  ENST ID: ENST00000619342
  CDS Start-End: 1-1866
atgtgttctgggtggtctagctcagtcatctggagacacacacagtttgctgtggaacgttgtggcttctgtggctcctcaggcccgggggcgccccttgaaccctccactcttggctccaagcaccttccctgggaagctgtatctgctgggttcgcagacaggaacagaaacatggatggagccatgtggctgagcctctgtcctgataacgaagacctgctttggaggaaaaagcacaaattgctacaagcccggggcaaaggcgatctcgctctgcagagaagagcggatgccaagctgtggaaaaactaccagctccagcgcttggctgaggagttgaggagagggtatcaggaggcacagcacctgcacgtcggtggcctggacaggctgcagtcagcacgtctgttgggctggggaggaggacgggccagggaaaatgagcctgactcgcaggggcccatccagcgaagatcagccaggcccccgagggccaaggagaagcatagagcagcccttagtgaagagaggagttgcagggaagagttgggccagcaacaccccaggcactccaggccccggaagacagcagcgagtccagagaaaccacagactacaaaagccacgggtcggatgaattctcacctggccccgcctgagaagagaaagggaaggccagaaccttcgaccaagtctgggggtggccgctgtgccatccatcctcggaggagcaaaggggcggacctagaaaggtcaaacccactcgtggctgctgtgggagaaatcgggcttgtggaggaaaaagagaaaggaacagctcgggcggggaggaggcaactgggaaagggggcagtttgctttgttccagccctgaccagtcgctctcagggacagagtctggaggggaagctgagagacctcgggcagctgtggccagctgattccagctgcagaagggaagccgtgtccccagcatctcagtgcacgctccgggagaagaacaagtggcagaaagagctggagttggcctttgaagagttgtttaatataaacagaaagctgaaaaaacacctgtgcttgtacctggcactgaagcccaggatggaccagagacctggggaagggcatgccttctcagagatgcaagagtgtggcgctgggaccccaagagggaagaaaatggcagacccagagatgctgcctgccggggaacccaggagcccagcagaggaggaggcgcagcaggcagcgtccaagaccgacttgaaaacgttcatgggcaaggcccagaaccaaaaatatcagggcacggtcaagcccacgtttagaaatggaagtcaaacattgtctcccgaggcaggtatatttatcaacaaagaggactcattattgtatagcactgaatctggacaagagacccccaaactgggcacgctggcagagggctcccttcagctccaccttcaagaccaggcagacagagtgggctcgacggcatccaggcaaaggcagaaagcagagatggagcagagaagacaaaaacaactggaatcgcttgaacaaatggaacacccagatatgagcttggaaatccactacaaagctgagctagaaaaagagaggagggagcaaagaagagctcgactggcccatctgaagtcctcctccacgagagcccaggaaagggagagaggatctgagctcagcaccacttccccatcgggcaccagcctcgccgacgacgaccggcacagtcagatgatccgagaccagcagcagcagatcttacagcaaaacaggttgcacaagcagtttcttgaagaagcccggaaatgcttgcgggagtttcagaacatatgctaa

SEQ ID NO: 116686 - DNA, 4450 bp, Homo sapiens
  Payload ID: 2754
  Gene Symbol: CERK
  Gene Name: ceramide kinase
  Uniprot ID: Q8TCT0
  ENST ID: ENST00000216264
  CDS Start-End: 114-1727
ccgcctcccgccgcccgccgcccgccgcccgggccactgcaggggccgctaacggtccggcgcccctcggcgtccgcgcgcccccagcctggcggacgagcccggcggcggagatgggggcgacgggggcggcggagccgctgcaatccgtgctgtgggtgaagcagcagcgctgcgccgtgagcctggagcccgcgcgggctctgctgcgctggtggcggagcccggggcccggagccggcgcccccggcgcggatgcctgctctgtgcctgtatctgagatcatcgccgttgaggaaacagacgttcacgggaaacatcaaggcagtggaaaatggcagaaaatggaaaagccttacgcttttacagttcactgtgtaaagagagcacgacggcaccgctggaagtgggcgcaggtgactttctggtgtccagaggagcagctgtgtcacttgtggctgcagaccctgcgggagatgctggagaagctgacgtccagaccaaagcatttactggtatttatcaacccgtttggaggaaaaggacaaggcaagcggatatatgaaagaaaagtggcaccactgttcaccttagcctccatcaccactgacatcatcgttactgaacatgctaatcaggccaaggagactctgtatgagattaacatagacaaatacgacggcatcgtctgtgtcggcggagatggtatgttcagcgaggtgctgcacggtctgattgggaggacgcagaggagcgccggggtcgaccagaaccacccccgggctgtgctggtccccagtagcctccggattggaatcattcccgcagggtcaacggactgcgtgtgttactccaccgtgggcaccagcgacgcagaaacctcggcgctgcatatcgttgttggggactcgctggccatggatgtgtcctcagtccaccacaacagcacactccttcgctactccgtgtccctgctgggctacggcttctacggggacatcatcaaggacagtgagaagaaacggtggttgggtcttgccagatacgacttttcaggtttaaagaccttcctctcccaccactgctatgaagggacagtgtccttcctccctgcacaacacacggtgggatctccaagggataggaagccctgccgggcaggatgctttgtttgcaggcaaagcaagcagcagctggaggaggagcagaagaaagcactgtatggtttggaagctgcggaggacgtggaggagtggcaagtcgtctgtgggaagtttctggccatcaatgccacaaacatgtcctgtgcttgtcgccggagccccaggggcctctccccggctgcccacttgggagacgggtcttctgacctcatcctcatccggaaatgctccaggttcaattttctgagatttctcatcaggcacaccaaccagcaggaccagtttgacttcacttttgttgaagtttatcgcgtcaagaaattccagtttacgtcgaagcacatggaggatgaggacagcgacctcaaggagggggggaagaagcgctttgggcacatttgcagcagccacccctcctgctgctgcaccgtctccaacagctcctggaactgcgacggggaggtcctgcacagccctgccatcgaggtcagagtccactgccagctggttcgactctttgcacgaggaattgaagagaatccgaagccagactcacacagctgagaagccggcgtcctgctcacaaactgggaaagtgtgaaaactatttaagataattattacagaccaattatgttgatatatacatttaaatgtagaaatttatttttgatagttaaatcttgattttagaagaaaacccttttgtcaacaattttgtgtacatatttggcattttcagttctgtacgcatctgcgggttgcagcccacgccgcttactctcagcggatgcagctgctcacttgggggcactggcctcttaggttttaacgatgtcaacagtgtagtttagaaaatggcccgttagtggctctattgcaataatgttagggacattatatgatttccacgcaggtcacaccatctgggcctgaggtagcagtgggtcactttgatccactttgcaggacttattctgtaacggtttgtggccaagttttgggaagtggttgattctctttgccttcatttcaccttcctcttcgtttacggttaggacatcgctgcttgatccttacaatactgtgcaactgcaatgcaacgtggccctgcttcaggtgatccgcgggaggggcctccacgccagcgccgggaaggctgctggggcctccacacctgcctcatcacggcggcgaggctacgacaatccggctgggagcatgaccttggcgtctgttctgggagcacggatgataagctctggaagctggcagtgtgtaaagcactggcaagtttgttactgttaaaatgtcaaataccaatgctttatatcgacgcgaagtgcttaacacagccgggcttgggggcagtcaggaggaagctggccatccgtggaggaggggccggtcctggactcccgcaggactcctctgaggcagggcctgaagtctgtacacgtggtccagatttgtccttgtcttttcttcacactgagttctctatatttattgaacatcttgtccttttaagccagagtagtgtaaactgcgtctcggatgtctgtcttttgcctcgaagccacgatggatcgctggtttcctctgcagcgcgagggctccggcgaccagaggattcttcccggaaggcattcctgccgcgctccccggggcacccctcaattgtgtactacgtccttgtttagtgtgtatccgtgcccacgtagatgatgtctgtaacgtagttttgtttgaaatatgagaatatgcggcttaaactttgatctgtaaggagcggggccgtggccgtttggagcacgctgtagacaccgttcctcatgctgccgggtgggttttgcagaagctcccttagtgatttcatgtttaacaggcagcatccattttcagaatttcctggcattgatttatattttgaagcatacaggaaacttctcgtttcctcgtttagccccacccagatcaggtgaaagggcagctttaatggtggtttttatggaccacattatcagagagcactgtgcaagccaaatggttcaataatgaatgaaaattctgggtgtaaagagtaaatatgccctggctctttctaccaatgtttgctcctggttggaaagaaaccaaagatttaagacgggctgctcttccagactggctgtgcctgcctgtgcccagcaacctgtgcagccggcagtgtgcctggtgtcacgccaggaggctgtggctgctgtgggccctctggaattgtgctcctcacaaagtttccccaaaaggttcttctaagcctttattgtccctggtaaatgtttcccggctgggcgcggtggctcacgcctgtaatcccagcactttgggaggccgaggcgggtggatcacctaaggtcaggagtttgagatcagcctgcccaacatggtgaaacctcgtctctactaaaaatacacaacttagccagtcttgttggcgcacgcctgtaatctcagctactagggatgctgaggcaggagaatcgcttgaacccaagaaagaggtggaggttgcggtgagccaagattgcgccactgcactccagcctgggcaaacagagggagactccatcgccccccccaacaaaaaaaaaagtttcccatacactggcctgccccaaaacccactaacaattttagcaaaacagtccaggccaaagaggaagcatttcatgttcaataagaaacccagccattccgcatggctggttcctgagtggctctggtgatactctccagccacctgctgacattcagaatctcagacctcgggactgctgttgcggtaccgtgtgtctgacacctgccagcagccctttgctatctgcgcgcaggatgggggtgactgcccagacattcccgctagataggctctgatttccggggcagcctttcagatgcggcagacatacaacacctgtactttagagttttaagggaaaaaaaatcagaagtgctggttagatagtaaaaacttaggataacttagaaaggctagttttagcttcctttgtggctccctggtgcaaaacaattagcagttatgcaatggacctgattctagtttattctaattaagaagtgaggccgagtttgacttcgttcctgaatacaatcttgagtaactgggaaagtctgagtgaaaggatggcctcattctctttctaatcttgctggtttcaagattagaaaatggcattatttgatctgaaatgtttgagaagacacgaataaagttacttgggcag

SEQ ID NO: 116687 - DNA, 1760 bp, Homo sapiens
  Payload ID: 2754
  Gene Symbol: CERK
  Gene Name: ceramide kinase
  ENST ID: ENST00000443629
  CDS Start-End: 60-617
gtccggcgcccctcggcgtccgcgcgcccccagcctggcggacgagcccggcggcggagatgggggcgacgggggcggcggagccgctgcaatccgtgctgtgggtgaagcagcagcgctgcgccgtgagcctggagcccgcgcgggctctgctgcgctggtggcggagcccggggcccggagccggcgcccccggcgcggatgcctgctctgtgcctgtatctgagatcatcgccgttgaggaaacagacgttcacgggaaacatcaaggcagtggaaaatggcagaaaatggaaaagccttacgcttttacagttcactgtgtaaagagagcacgacggcaccgctggaagtgggcgcaggtgactttctggtgtccagaggagcagctgtgtcacttgtggctgcagaccctgcgggagatgctggagaagctgacgtccagaccaaagcatttactggtatttatcaacccgtttggaggaaaaggacaaggcaagcggatatatgaaagaaaagtggcaccactgttcaccttagcctccatcaccactgacatcatcgcatcgtctgtgtcggcggagatggtatgttcagcgaggtgctgcacggtctgattgggaggacgcagaggagcgccggggtcgaccagaaccacccccgggctgtgctggtccccagtagcctccggattggaatcattcccgcagggtcaacggactgcgtgtgttactccaccgtgggcaccagcgacgcagaaacctcggcgctgcatatcgttgttggggactcgctggccatggatgtgtcctcagtccaccacaacagcacactccttcgctactccgtgtccctgctgggctacggcttctacggggacatcatcaaggacagtgagaagaaacggtggttgggtcttgccagatacgacttttcaggtttaaagaccttcctctcccaccactgctatgaagggacagtgtccttcctccctgcacaacacacggtgggatctccaagggataggaagccctgccgggcaggatgctttgtttgcaggcaaagcaagcagcagctggaggaggagcagaagaaagcactgtatggtttggaagctgcggaggacgtggaggagtggcaagtcgtctgtgggaagtttctggccatcaatgccacaaacatgtcctgtgcttgtcgccggagccccaggggcctctccccggctgcccacttgggagacgggtcttctgacctcatcctcatccggaaatgctccaggttcaattttctgagatttctcatcaggcacaccaaccagcaggaccagtttgacttcacttttgttgaagtttatcgcgtcaagaaattccagtttacgtcgaagcacatggaggatgaggacagcgacctcaaggagggggggaagaagcgctttgggcacatttgcagcagccacccctcctgctgctgcaccgtctccaacagctcctggaactgcgacggggaggtcctgcacagccctgccatcgaggtcagagtccactgccagctggttcgactctttgcacgaggaattgaagagaatccgaagccagactcacacagctgagaagccggcgtcctgctcacaaactgggaaagtgtgaaaactatttaagataattattacagaccaattatgttgatatatacatttaaatgtagaaatttatttttgatagttaaatcttgattttagaagaaaacccttttgtcaacaa

SEQ ID NO: 116688 - DNA, 1677 bp, Homo sapiens
  Payload ID: 2755
  Gene Symbol: CERKL
  Gene Name: ceramide kinase-like
  Uniprot ID: Q49MI3
  ENST ID: ENST00000339098
  CDS Start-End: 1-1677
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttgatggtgggcatcggaaaccattgttcgcaatacattggagtgtacagagattgttcactggcatgcaaacgttagaaccaagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 116689 - DNA, 1535 bp, Homo sapiens
  Payload ID: 2755
  Gene Symbol: CERKL
  Gene Name: ceramide kinase-like
  Uniprot ID: Q49MI3
  ENST ID: ENST00000374967
  CDS Start-End: 1-654
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaatgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 116690 - DNA, 1330 bp, Homo sapiens
  Payload ID: 2755
  Gene Symbol: CERKL
  Gene Name: ceramide kinase-like
  Uniprot ID: Q49MI3
  ENST ID: ENST00000374969
  CDS Start-End: 1-1260
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaacatgtaattgtttctaaaagaaatgtacaaactagaattttaatataaagaaatgtggccatgctttaaa

SEQ ID NO: 116691 - DNA, 1392 bp, Homo sapiens
  Payload ID: 2755
  Gene Symbol: CERKL
  Gene Name: ceramide kinase-like
  Uniprot ID: Q49MI3
  ENST ID: ENST00000374970
  CDS Start-End: 1-1392
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaagatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 116692 - DNA, 3208 bp, Homo sapiens
  Payload ID: 2755
  Gene Symbol: CERKL
  Gene Name: ceramide kinase-like
  Uniprot ID: Q49MI3
  ENST ID: ENST00000410087
  CDS Start-End: 102-1700
gcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttgatggtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttcatg

SEQ ID NO: 116693 - DNA, 2425 bp, Homo sapiens
  Payload ID: 2755
  Gene Symbol: CERKL
  Gene Name: ceramide kinase-like
  Uniprot ID: Q49MI3
  ENST ID: ENST00000409440
  CDS Start-End: 102-1646
gcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcagtaatggaatatgaagggcacgctctgtcactgcttaaggaatgtgaactccagggatttgatggtgggcatcggaaaccattgttcgcaatacattggagtgtacagagattgttcactggcatgcaaacgttagaaccaagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactat

SEQ ID NO: 116694 - DNA, 1403 bp, Homo sapiens
  Payload ID: 2755
  Gene Symbol: CERKL
  Gene Name: ceramide kinase-like
  Uniprot ID: Q49MI3
  ENST ID: ENST00000452174
  CDS Start-End: 1-522
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 116695 - DNA, 1395 bp, Homo sapiens
  Payload ID: 2755
  Gene Symbol: CERKL
  Gene Name: ceramide kinase-like
  Uniprot ID: Q49MI3
  ENST ID: ENST00000421817
  CDS Start-End: 19-540
ccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaagactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 116696 - DNA, 2094 bp, Homo sapiens
  Payload ID: 2756
  Gene Symbol: CERS1
  Gene Name: ceramide synthase 1
  Uniprot ID: P27544
  ENST ID: ENST00000429504
  CDS Start-End: 64-1077
gcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgccctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagtgagtgtggaggggcccgcaccccgcgttccctcctttagtgtcacccgtccaagcgtgttcgtgggcaggcccccaagacccagcagcagatgaggccgacgcggatgctgccccccaagcctactccaaaacagagactgcaataaaggcgtggacgatgtggccagtaccctgaaggacaggacagtgaggaaggggagggagaggctggggaggggcaggcagggcgacaggcagggtctcagcggtagggacactgagggccaggcctagtggctggtgtggcgggagtggcgagccagggccctgtgggtggtgaggagtagttgctggccagcctggatgacgacctctgacccatgtcgccactggagctggtggcagtggggctggggaggaaggaacgccaagggccacagagagaacccaggctccatctgggccgagacatcctggcctctgagtttgacaggggagcccactgcccggccaaacaggagctggggctgggagctcagactcagtccagcccaggtgggagtcctggggaaggagatagcccacgagcctcaccagccctgggtgacagccagatggtgtccgaagccccaggcctggggcaggcagggggtgtctgggccagggatgaacggaggccaaactgggtaacaagcagagtcgggtgtgcagtgtctcataggcaacgtgaggagtgtttgagcaggagccggggcaggaggttgtggaaggccctggaaggtgccgaccagccaggccctctgatttggccggtgggggccatcggtgacgtgggaacgatggtttcagggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacgactcaaga

SEQ ID NO: 116697 - DNA, 1947 bp, Homo sapiens
  Payload ID: 2756
  Gene Symbol: CERS1
  Gene Name: ceramide synthase 1
  ENST ID: ENST00000542296
  CDS Start-End: 213-932
aggtgcgcctcccaacgccctggcgtgggccgtgtccttttgaagaatgagaatgtttcattgagcctacgcctcctgaatgcgggagggccacgggatggtcccaagactgtgccaaggcgtgccaggcctcgggtccttgagaaggagcgagggctccaagaacgcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagtgagtgtggaggggcccgcaccccgcgttccctcctttagtgtcacccgtccaagcgtgttcgtgggcaggcccccaagacccagcagcagatgaggccgacgcggatgctgccccccaagcctactccaaaacagagactgcaataaaggcgtggacgatgtggccagtaccctgaaggacaggacagtgaggaaggggagggagaggctggggaggggcaggcagggcgacaggcagggtctcagcggtagggacactgagggccaggcctagtggctggtgtggcgggagtggcgagccagggccctgtgggtggtgaggagtagttgctggccagcctggatgacgacctctgacccatgtcgccactggagctggtggcagtggggctggggaggaaggaacgccaagggccacagagagaacccaggctccatctgggccgagacatcctggcctctgagtttgacaggggagcccactgcccggccaaacaggagctggggctgggagctcagactcagtccagcccaggtgggagtcctggggaaggagatagcccacgagcctcaccagccctgggtgacagccagatggtgtccgaagccccaggcctggggcaggcagggggtgtctgggccagggatgaacggaggccaaactgggtaacaagcagagtcgggtgtgcagtgtctcataggcaacgtgaggagtgtttgagcaggagccggggcaggaggttgtggaaggccctggaaggtgccgaccagccaggccctctgatttggccggtgggggccatcggtgacgtgggaacgatggtttcagggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacgactcaa

SEQ ID NO: 116698 - DNA, 749 bp, Homo sapiens
  Payload ID: 2756
  Gene Symbol: CERS1
  Gene Name: ceramide synthase 1
  ENST ID: ENST00000596048
  CDS Start-End: 1-649
tgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgaggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacg

SEQ ID NO: 116699 - DNA, 2517 bp, Homo sapiens
  Payload ID: 2756
  Gene Symbol: CERS1
  Gene Name: ceramide synthase 1
  Uniprot ID: P27544
  ENST ID: ENST00000623882
  CDS Start-End: 25-1077
gggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgccctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagaagccactgaggaacggcctggtgaaggacaagcgcttctgaacccctcggccccgcccccgtggacccggccccaccccgaataccccggccacgctccccgtccttggccgcccctccaccccctccaactctgctcctctagggccgccgccacctcccctgggaccccgccccctcatcctgcctccagttcccggccacgccccccaggacccctgcccctccggggacaccggccccgccctcagcccactggtcccgggccgccgcggaccctgcgcactctctggtcatcgcctgggaggaagatgccaccgccgcagcaaggtccctgcggccaccacctcctcctcctcctggccctgctgctgccctcgctgcccctgacccgcgcccccgtgcccccaggcccagccgccgccctgctccaggctctaggactgcgcgatgagccccagggtgcccccaggctccggccggttcccccggtcatgtggcgcctgtttcgacgccgggacccccaggagaccaggtctggctcgcggcggacgtccccaggggtcaccctgcaaccgtgccacgtggaggagctgggggtcgccggaaacatcgtgcgccacatcccggaccgcggtgcgcccacccgggcctcggagcctgcctcggccgcggggcattgccctgagtggacagtcgtcttcgacctgtcggctgtggaacccgctgagcgcccgagccgggcccgcctggagctgcgtttcgcggcggcggcggcggcagccccggagggcggctgggagctgagcgtggcgcaagcgggccagggcgcgggcgcggaccccgggccggtgctgctccgccagttggtgcccgccctggggccgccagtgcgcgcggagctgctgggcgccgcttgggctcgcaacgcctcatggccgcgcagcctccgcctggcgctggcgctacgcccccgggcccctgccgcctgcgcgcgcctggccgaggcctcgctgctgctggtgaccctcgacccgcgcctgtgccaccccctggcccggccgcggcgcgacgccgaacccgtgttgggcggcggccccgggggcgcttgtcgcgcgcggcggctgtacgtgagcttccgcgaggtgggctggcaccgctgggtcatcgcgccgcgcggcttcctggccaactactgccagggtcagtgcgcgctgcccgtcgcgctgtcggggtccggggggccgccggcgctcaaccacgctgtgctgcgcgcgctcatgcacgcggccgccccgggagccgccgacctgccctgctgcgtgcccgcgcgcctgtcgcccatctccgtgctcttctttgacaacagcgacaacgtggtgctgcggcagtatgaggacatggtggtggacgagtgcggctgccgctaacccggggcgggcagggacgcgggcccaacaataaatgccgcgtggtctgctc

SEQ ID NO: 116700 - DNA, 2558 bp, Homo sapiens
  Payload ID: 2756
  Gene Symbol: CERS1
  Gene Name: ceramide synthase 1
  ENST ID: ENST00000623927
  CDS Start-End: 1395-2513
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgccctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagaagccactgaggaacggcctggtgaaggacaagcgcttctgaacccctcggccccgcccccgtggacccggccccaccccgaataccccggccacgctccccgtccttggccgcccctccaccccctccaactctgctcctctagggccgccgccacctcccctgggaccccgccccctcatcctgcctccagttcccggccacgccccccaggacccctgcccctccggggacaccggccccgccctcagcccactggtcccgggccgccgcggaccctgcgcactctctggtcatcgcctgggaggaagatgccaccgccgcagcaaggtccctgcggccaccacctcctcctcctcctggccctgctgctgccctcgctgcccctgacccgcgcccccgtgcccccaggcccagccgccgccctgctccaggctctaggactgcgcgatgagccccagggtgcccccaggctccggccggttcccccggtcatgtggcgcctgtttcgacgccgggacccccaggagaccaggtctggctcgcggcggacgtccccaggggtcaccctgcaaccgtgccacgtggaggagctgggggtcgccggaaacatcgtgcgccacatcccggaccgcggtgcgcccacccgggcctcggagcctgcctcggccgcggggcattgccctgagtggacagtcgtcttcgacctgtcggctgtggaacccgctgagcgcccgagccgggcccgcctggagctgcgtttcgcggcggcggcggcggcagccccggagggcggctgggagctgagcgtggcgcaagcgggccagggcgcgggcgcggaccccgggccggtgctgctccgccagttggtgcccgccctggggccgccagtgcgcgcggagctgctgggcgccgcttgggctcgcaacgcctcatggccgcgcagcctccgcctggcgctggcgctacgcccccgggcccctgccgcctgcgcgcgcctggccgaggcctcgctgctgctggtgaccctcgacccgcgcctgtgccaccccctggcccggccgcggcgcgacgccgaacccgtgttgggcggcggccccgggggcgcttgtcgcgcgcggcggctgtacgtgagcttccgcgaggtgggctggcaccgctgggtcatcgcgccgcgcggcttcctggccaactactgccagggtcagtgcgcgctgcccgtcgcgctgtcggggtccggggggccgccggcgctcaaccacgctgtgctgcgcgcgctcatgcacgcggccgccccgggagccgccgacctgccctgctgcgtgcccgcgcgcctgtcgcccatctccgtgctcttctttgacaacagcgacaacgtggtgctgcggcagtatgaggacatggtggtggacgagtgcggctgccgctaacccggggcgggcagggacgcgggcccaacaataaatgccgcgtgg

SEQ ID NO: 116701 - DNA, 2544 bp, Homo sapiens
  Payload ID: 2757
  Gene Symbol: CERS2
  Gene Name: ceramide synthase 2
  Uniprot ID: Q96G23
  ENST ID: ENST00000271688
  CDS Start-End: 427-1569
agcgcaaggtgacgggcgtggacgcggctgtggggccgggagcggagggttggggtctggcctcccgcgccggggcgaaggggcagccgcagcgcagaggcccgccccgccctcccctcccgtcacgcccagcctcccggcccttgggctgctcgcggcctttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccggctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattactccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaataaaacatggcaataagtgtcagactattaggaattgagaagggggatcaactaaataaacgaagagagtctttcttatgccttccttgca

SEQ ID NO: 116702 - DNA, 997 bp, Homo sapiens
  Payload ID: 2757
  Gene Symbol: CERS2
  Gene Name: ceramide synthase 2
  ENST ID: ENST00000361419
  CDS Start-End: 250-997
ctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccggctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggaggtcaggc

SEQ ID NO: 116703 - DNA, 1002 bp, Homo sapiens
  Payload ID: 2757
  Gene Symbol: CERS2
  Gene Name: ceramide synthase 2
  ENST ID: ENST00000368949
  CDS Start-End: 89-1002
atctgaagtctaggactgccagggcaacatggtacctttggctttacatttccctggagaagttgggctccaagagacagcagtcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttctt

SEQ ID NO: 116704 - DNA, 2505 bp, Homo sapiens
  Payload ID: 2757
  Gene Symbol: CERS2
  Gene Name: ceramide synthase 2
  Uniprot ID: Q96G23
  ENST ID: ENST00000368954
  CDS Start-End: 388-1530
tagcgcaaggtgacgggcgtggacgcggctgtggggccgggagcggagggttggggtctggcctcccgcgccggggcgaaggggcagccgcagcgcagaggcccgccccgccctcccctcccgtcacgcccagcctcccggcccttgggctgctcgcggcctttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattactccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaataaaacatggcaataagtgtcagactattaggaattgagaagggggatcaactaaataaacgaagagagtctttcttatgccttccttgca

SEQ ID NO: 116705 - DNA, 738 bp, Homo sapiens
  Payload ID: 2757
  Gene Symbol: CERS2
  Gene Name: ceramide synthase 2
  ENST ID: ENST00000421609
  CDS Start-End: 162-738
gggaggcggcgctggcggggggcgctgcgggcgctcatggcggcggccgccgggtaaggcgggcgcagcgcctcaagggagcggccggggccggcgggcctggcgccgcggtgtccgcggcagcgccgccctgagccggagaagctttcccgggcaacaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccc

SEQ ID NO: 116706 - DNA, 545 bp, Homo sapiens
  Payload ID: 2757
  Gene Symbol: CERS2
  Gene Name: ceramide synthase 2
  ENST ID: ENST00000457392
  CDS Start-End: 160-545
gcggccgccgggtaaggcgggcgcagcgcctcaagggagcggccggggccggcgggcctggcgccgcggtgtccgcggcagcgccgccctgagccggagaagctttcccgggcaacagctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtct

SEQ ID NO: 116707 - DNA, 896 bp, Homo sapiens
  Payload ID: 2757
  Gene Symbol: CERS2
  Gene Name: ceramide synthase 2
  ENST ID: ENST00000558062
  CDS Start-End: 229-896
caggcatgagccatcacggccggcctaacagtaaatgttaaaactggaaagccaccgtattacagatgaggaaactgatttgcccaaggctacatagccaggatagggatctagagttcgactctctgcccccttctccttttgatacatcctgaaaacttttattcatctatctcttcctccatagctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttc

SEQ ID NO: 116708 - DNA, 1661 bp, Homo sapiens
  Payload ID: 2757
  Gene Symbol: CERS2
  Gene Name: ceramide synthase 2
  ENST ID: ENST00000560793
  CDS Start-End: 1-686
tctctctgcagaaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattactccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaataaaacatggcaataagtgtcagactattaggaattgagaagggggatcaactaaataaacgaagagagtctttcttatgccttccttgca

SEQ ID NO: 116709 - DNA, 1803 bp, Homo sapiens
  Payload ID: 2757
  Gene Symbol: CERS2
  Gene Name: ceramide synthase 2
  ENST ID: ENST00000561294
  CDS Start-End: 23-1156
tcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaaggagctggggggagtagctagcccagagacttcgggtcagggttcaacaatcaggaagacccagttcctgaggaaacgacagttcaagaagggttgggaagaaggctgtcctctaaagaagacgtcctctgcattcaatggccccacagcaacagagtagctccttgccttccacactgcccacctcgtagttgtagtcccaagtaagttctgtcccagcccggattcttctgaagaggaagaaaaggatggtgtgtggcaaagacagcagataacccaggcacttggggttactgaatatgtaggtggagttggatcatgaatggaggaggggcccttagaacttcagtggtccttgcccctccccagtcatcccctttcctgactccttacttgctggcaaagaaggccacccaggggaagcgaagatcatgggtatccacgaagacattctggacaaacaggttggggctgcaactgtgctgtaggtttaaggacaggatcaaataagaaccagggaaactgaacctggctttgcagggagagtgagagttggaagaaaaatgatgccatctgaccctccccattataatagatgctttgaaagaaagctacctctttaagatcctttgagatcaagagtttataacaagaaaagggcttatagagtatgttaaaagaaatctgaggaccatgggataatccagcatctagaggtggggagaggggtctcacgttgaggtagcggcccaggttgccttcaagcttggcatcaatgatgtagcaagactcctcgccatcatagaa

SEQ ID NO: 116710 - DNA, 3894 bp, Homo sapiens
  Payload ID: 2758
  Gene Symbol: CERS3
  Gene Name: ceramide synthase 3
  Uniprot ID: Q8IU89
  ENST ID: ENST00000284382
  CDS Start-End: 425-1576
cgggatgcaccgctgcggggaccccccgcccggcctcgcggacccgcctcggcccaggacggaggaggaggtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcagacgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggattttctagctcatatcatccaccacctggctgctattagtctgatgagcttctcttggtgtgctaattatattcgcagtgggaccctcgtgatgattgtacacgatgtggctgacatttggctggagtctgctaagatgttttcttatgctggatggacgcagacctgtaacaccctgtttttcatcttctccaccatatttttcatcagccgcctcattgtttttcctttctggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaagagcatccaggatgtgaggagtgatgacgaggattatgaagaggaagaggaagaggaagaagaagaggctaccaaaggcaaagagatggattgtttaaagaacggcctcagggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgcagttaggactcagactggtcaaagatttcaaagatttctccacagaaccgtctcagttctaattgcactccctcatgcatgtcactttctcaggggctcgctttgttatagaccctttcgcctcgccaccttgcctgtcctcaggacgctttcacaggtgctaagtgatctcatttttcccaggtgtgtttggccacaaagagcagcttctttctcaaaatgagttagaagtggcagtgggacaggagcggaaggaccacaccaggagacacttccatcctgaagcttaggtgcctcatctccacagggcggtggcagtccctgcctgccaccccacagggttacagcaaggattaagtgagatcacagaagtttaagtacacactgtcaaccgtggggtcatcgtgaaccaacccactttgcactgtttgggagacagaaacctggctaaacatggcactgcaatgggcctgaacaaaaggcagaatctttaaaaattcctcttaaatgactctggagatacctggaaatgaaagtgccaagaaaggtgttccattttatttgctaactatttatgcattagctccccaagggtcattctcagattctcctggaattcttctccctcaggacccatggttcaaggaaggaagcttaggccctgttccttcctgtcctttgctggtctttcccttttttcctttctaggagggaagcttctgtgctgctgccctgagcccttccttcaggccagcacagtacctggggacctccacgggggaatgggatccaggccaggttgcttgctgagcctcatcacccaggaggcctgagcctctggggagggcacgcatgtacactgccagacccaggggagatcttgggaacagaggatgctacgtgatttcctctggcttccaacccaatcagcctgcatcacagtgaaacacaacacaaaaggccataaaaggcatacccctgagaaatgtttaagggcaggtgctagagtcagtgccagctccctgggaggagggatagggacgggcagatcagtagccagcttgtcctcaccctccggaagggagcaccggagaagacttgcacacgtccctgcctcccttgcggccttgtcaccagagggacacatctcctgggcacaatgtgcagggctgacctgggagacttctcaggtggctgctggctgaggagaggccaggccttcccaaggaagaccctgagtaaaatctgcatctgtcctcaccacctggcacagtctctcataacggtcagattttgtatgttcatcctatttattcaggggctcgtactagaaagccacaggagaggtcggcttgtagggactggaaaatcagccccaagcagagcagctgcagggcccctggagccggaaggacactgcacagaacagactgcgttattgttatttttaaataaaaatatacatttgaaaccttaaggctaaacaaaaataaacaaaaaatcctttagaattctttccacaacaatatctctttctgagaaattgttacaaacaaggtcagattttctctgtataacatttgcttttatgaggacaatatcatatgcattatatgcataatatgatattataaatcaaaatgcctgcacccactttagggtatagctattgacttattattaatattatattattattattttgctggaagaaggtcacactaagatataattttttatgttttcagttaacggtatgctttcttctttgcttatttggtttttgtctctgtaccaaatatcttcttgcttaaggtagaaaagtatttgtttacctctatctccagttttttttcttatttgaatgttgaaggtaaaattgatataccaattttaactatttctgatacagctgaaagcactaaactacttcataagaagtagatactcatttttgtaacactatttagggcttttgtggttaattttaaaggaaaccactctttctacaggaaacaagggctcaggattcttcagatgaccttataaaaatgcagtccacagtgctatcaatattgtaacagtaatgactacaataaagccaaaagtccagtgta

SEQ ID NO: 116711 - DNA, 2045 bp, Homo sapiens
  Payload ID: 2758
  Gene Symbol: CERS3
  Gene Name: ceramide synthase 3
  Uniprot ID: Q8IU89
  ENST ID: ENST00000394113
  CDS Start-End: 692-1843
gagggcccgtgtccccgcggaggtcaaggccgagagagggcccgtgtccccgcgcaggtcaaggcccagagtccccgtgctcgcacagatggtgtcctggggcccagtcgcgctccccgctcgcggcagcccccgtgtactgggccttgcaaagtccgttaggagcgctccagggcgacagtgcccagcggttaacaagtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagatggcgttattccctctggtccccactgctctggccaaaccttctctctgctgactgcatctattgctgtgagctgattgtcctctagtttctccatctcctgaggcatgcttcacaccactgccagaagagctgccagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcagacgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggattttctagctcatatcatccaccacctggctgctattagtctgatgagcttctcttggtgtgctaattatattcgcagtgggaccctcgtgatgattgtacacgatgtggctgacatttggctggagtctgctaagatgttttcttatgctggatggacgcagacctgtaacaccctgtttttcatcttctccaccatatttttcatcagccgcctcattgtttttcctttctggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaagagcatccaggatgtgaggagtgatgacgaggattatgaagaggaagaggaagaggaagaagaagaggctaccaaaggcaaagagatggattgtttaaagaacggcctcagggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgca

SEQ ID NO: 116712 - DNA, 1856 bp, Homo sapiens
  Payload ID: 2758
  Gene Symbol: CERS3
  Gene Name: ceramide synthase 3
  Uniprot ID: Q8IU89
  ENST ID: ENST00000538112
  CDS Start-End: 503-1654
ggccttgcaaagtccgttaggagcgctccagggcgacagtgcccagcggttaacaagtttgtaattactttcgtgggtttctacgttgcaaattgagaagagggttgctgggttgggcccccctcctctggacgctaaccccacccaggtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcagacgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggattttctagctcatatcatccaccacctggctgctattagtctgatgagcttctcttggtgtgctaattatattcgcagtgggaccctcgtgatgattgtacacgatgtggctgacatttggctggagtctgctaagatgttttcttatgctggatggacgcagacctgtaacaccctgtttttcatcttctccaccatatttttcatcagccgcctcattgtttttcctttctggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaagagcatccaggatgtgaggagtgatgacgaggattatgaagaggaagaggaagaggaagaagaagaggctaccaaaggcaaagagatggattgtttaaagaacggcctcagggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgca

SEQ ID NO: 116713 - DNA, 432 bp, Homo sapiens
  Payload ID: 2758
  Gene Symbol: CERS3
  Gene Name: ceramide synthase 3
  ENST ID: ENST00000559639
  CDS Start-End: 387-432
gtgtactgggccttgcaaagtccgttaggagcgctccagggcgacagtgcccagcggttaacaagtttgtaattactttcgtgggtttctacgttgcaaattgagaagagggttgctgggttgggcccccctcctctggacgctaaccccacccagggatgttgtgaaacaaaagctgacatttatatatatatacatatatacagtatttgagttcctcagtagaaagctatcatatatactcagatggcgttattccctctggtccccactgctctggccaaaccttctctctgctgactgcatctattgctgtgagctgattgtcctctagtttctccatctcctgaggcatgcttcacaccactgccagaagagctgccagaatgttttggacgtttaaagaatggttctggttggaaagattctggc

SEQ ID NO: 116714 - DNA, 920 bp, Homo sapiens
  Payload ID: 2758
  Gene Symbol: CERS3
  Gene Name: ceramide synthase 3
  ENST ID: ENST00000558884
  CDS Start-End: 433-920
tcgcggcagcccccgtgtactgggccttgcaaagtccgttaggagcgctccagggcgacagtgcccagcggttaacaagtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcagacgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatg

SEQ ID NO: 116715 - DNA, 1797 bp, Homo sapiens
  Payload ID: 2759
  Gene Symbol: CERS4
  Gene Name: ceramide synthase 4
  Uniprot ID: Q9HA82
  ENST ID: ENST00000251363
  CDS Start-End: 301-1485
ggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaa

SEQ ID NO: 116716 - DNA, 1803 bp, Homo sapiens
  Payload ID: 2759
  Gene Symbol: CERS4
  Gene Name: ceramide synthase 4
  ENST ID: ENST00000558331
  CDS Start-End: 460-1491
gccccgggctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaa

SEQ ID NO: 116717 - DNA, 768 bp, Homo sapiens
  Payload ID: 2759
  Gene Symbol: CERS4
  Gene Name: ceramide synthase 4
  ENST ID: ENST00000561053
  CDS Start-End: 360-768
cccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagacctcccagctaactggaacctgtgtccacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggcca

SEQ ID NO: 116718 - DNA, 568 bp, Homo sapiens
  Payload ID: 2759
  Gene Symbol: CERS4
  Gene Name: ceramide synthase 4
  ENST ID: ENST00000560412
  CDS Start-End: 474-568
actgtccccctcggggcttcccatcatggccgtctccccgagctatccgcgctcccccacgagggccggggcgcaacgggtgcccgaggacgcggctgtgaaacgggctggagcgagtaggggcgatcctggcctcgtgacgcgggggaatccggatgtgtgagccgggggagcgccccgtttccccgacgtgccagggctggggacgcagctggggccctggcctcggagtccgcagcccggccgcgtagacggcttctgagaaccgcttaaacacgtcattccaagcccgagctaacccatcaggcggccggggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgt

SEQ ID NO: 116719 - DNA, 713 bp, Homo sapiens
  Payload ID: 2759
  Gene Symbol: CERS4
  Gene Name: ceramide synthase 4
  ENST ID: ENST00000558268
  CDS Start-End: 374-713
ccacggccccgccccgggctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccagcctcaaatgggtctgccttccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcaga

SEQ ID NO: 116720 - DNA, 1637 bp, Homo sapiens
  Payload ID: 2759
  Gene Symbol: CERS4
  Gene Name: ceramide synthase 4
  Uniprot ID: Q9HA82
  ENST ID: ENST00000559450
  CDS Start-End: 141-1325
gccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaa

SEQ ID NO: 116721 - DNA, 531 bp, Homo sapiens
  Payload ID: 2759
  Gene Symbol: CERS4
  Gene Name: ceramide synthase 4
  ENST ID: ENST00000561008
  CDS Start-End: 255-531
attatctttcttttccaggtgtgcaaacaagctcttggagggaaggagaggagaaaataaacaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagacctcccagctaactggaacctgtgtccacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggc

SEQ ID NO: 116722 - DNA, 1515 bp, Homo sapiens
  Payload ID: 2759
  Gene Symbol: CERS4
  Gene Name: ceramide synthase 4
  ENST ID: ENST00000559336
  CDS Start-End: 283-1203
ggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaa

SEQ ID NO: 116723 - DNA, 758 bp, Homo sapiens
  Payload ID: 2759
  Gene Symbol: CERS4
  Gene Name: ceramide synthase 4
  ENST ID: ENST00000558877
  CDS Start-End: 182-758
gtgacctgggagcagcagaaatctggaaactgacagcatggacgtgctggccgcagcttccaggatctgctccgtcacccaggctggagtgcagtggtgtgatcacagctcactgcagcctcaaactcctgggctcaaccagtcctctcacctcagcctcctgagtagccgggattacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcac

SEQ ID NO: 116724 - DNA, 2051 bp, Homo sapiens
  Payload ID: 2760
  Gene Symbol: CERS5
  Gene Name: ceramide synthase 5
  Uniprot ID: Q8N5B7
  ENST ID: ENST00000317551
  CDS Start-End: 126-1304
ccagaaggggccggaagggggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaaccca

SEQ ID NO: 116725 - DNA, 2998 bp, Homo sapiens
  Payload ID: 2760
  Gene Symbol: CERS5
  Gene Name: ceramide synthase 5
  ENST ID: ENST00000380189
  CDS Start-End: 24-611
ggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcattcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaagatggaatctcgctctgttgcccaggctggagtgcaatgtcacgatcttggctcaccacaacctccacctcctgggttcaagcgattctcctgcctcagcctccctagtagctgggattacaggcgcatgccaccaggcctggctaatttttgtattcttagtagaaacggggtttcactatgttggccaggctggtctctaactcccgaccttgtgatctgcccaccttggcctcccgaagtgctgggattacaggcgtgagccaccgcacctggcctgcctgttttaccttttaagatgtgacttagacgcaagaggaaagttctaccttcttcctgtcccttaggaatggcttttgttaaaggatgatagggttaagagttttttaagagatggcctcaaccatttcctaccccttacctacctgcttcagtggatttcatatttttctttttgacatggggcccttttcaaaggaaatcatatgcagaaccatataaactgtataaaagcagattgttaagttgcctagaagtggtgtgtggtagttcacaagccaccacaaggtgaccatgctgtgatattcaagatatggtttatataaggaactaaatacccacctcaccccactagtgtatgaggcaagtgtcctaagtgaatgggtatgtagtgtttcaaatacccatcttatgccaagagcgaaagaaaggtgccacttaatgataaactcataattgaactttgcaagttttgaagcagtcagactgtagtcaaagggctagggatttcagcctaaaggaatacagaatcccaagtgggaggggctctgcttgagcaggtactgatactaggaccaagtgatggaatgtggcctagatattgatgatctcctgcatcattattccttatagctgccattggctcagaacttgctcagtgtgcctgtgcatcttgctgtagctactggacatctctgttctctcctgcttttctttcctgactaggtgacctgtccaggaaggattagaccctgtactctccactctttcctcacctccttccttttttctatgcctggcgggagctggacagtttcatctcttgcatgtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaaccca

SEQ ID NO: 116726 - DNA, 2855 bp, Homo sapiens
  Payload ID: 2760
  Gene Symbol: CERS5
  Gene Name: ceramide synthase 5
  Uniprot ID: Q8N5B7
  ENST ID: ENST00000422340
  CDS Start-End: 612-1616
ggatccccggaggcggtccccgggttgcagtgagggaagtgggccgggaggagagatgggcggtgaagaggcccggccctgccagggaggcgggcggatccgtggcagtgaccagaaggggccggaagggggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagagatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaacccacctctactgtctcaacctcttcagtgactctatccgcagtttcctgaatccataagctaattaagagcttttccaggtctgattcagaaggccctggacaccaaatttttcctttctgtgcatggtaggaagagtcagccagggtgcttacattttagagctttatgttttttaagaaaaagaagaatcacttgaacctgggaggcagaggttgcagcgagccaagatcgtgccactgcactccagcctgggcgacagaccgagactctgtctaaaaaaaaaaaaaaaaaaaaaaattaggtcatacttttagttcctcaacttgctatattgaatagactaatattgttgtgaaatatgaatgaatatgcttttgaaagtcagatgagaaatgtattttgccttctgaaatttgaacaattgccttgttaatacaaactggattggttggtgtagctaatctgacaaaagatgcaattggataaaacaata

SEQ ID NO: 116727 - DNA, 945 bp, Homo sapiens
  Payload ID: 2760
  Gene Symbol: CERS5
  Gene Name: ceramide synthase 5
  ENST ID: ENST00000438450
  CDS Start-End: 97-636
ggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctga

SEQ ID NO: 116728 - DNA, 951 bp, Homo sapiens
  Payload ID: 2760
  Gene Symbol: CERS5
  Gene Name: ceramide synthase 5
  ENST ID: ENST00000542320
  CDS Start-End: 4-591
aagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcattcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctgtttttctgttctattctattctactttcgccaatagaacacaagaaccctattgccctgcttttaccttagcctgtgctgaccttctgtggactctcataggacctctgctgcctcagaccgtatttctagcaa

SEQ ID NO: 116729 - DNA, 522 bp, Homo sapiens
  Payload ID: 2760
  Gene Symbol: CERS5
  Gene Name: ceramide synthase 5
  ENST ID: ENST00000546514
  CDS Start-End: 63-296
gttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgagtctgctttgtcgcccagactggagtgcagtggtgagatctcagctcactgcaacctctgtctcccgagttcaagagatcctctcacctcagcctcctgagcagctgggactacagatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagc

SEQ ID NO: 116730 - DNA, 579 bp, Homo sapiens
  Payload ID: 2760
  Gene Symbol: CERS5
  Gene Name: ceramide synthase 5
  ENST ID: ENST00000550258
  CDS Start-End: 30-230
ggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgataaagatattcactgaggctttggtgtgtgatattataatgtgaatttatacctgtgggtgattttgatcaagtctactcagactccaagaaaggagacatgtttctgccataggcctcagatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtga

SEQ ID NO: 116731 - DNA, 407 bp, Homo sapiens
  Payload ID: 2760
  Gene Symbol: CERS5
  Gene Name: ceramide synthase 5
  ENST ID: ENST00000550547
  CDS Start-End: 1-407
atttatgtatattctgctatggaattagatttctctggtcggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggatt

SEQ ID NO: 116732 - DNA, 1218 bp, Homo sapiens
  Payload ID: 2760
  Gene Symbol: CERS5
  Gene Name: ceramide synthase 5
  ENST ID: ENST00000553122
  CDS Start-End: 1-335
ccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtgacctgtccaggaaggattagaccctgtactctccactctttcctcacctccttccttttttctatgcctggcgggagctggacagtttcatctcttgcatgtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaaccca

SEQ ID NO: 116733 - DNA, 2132 bp, Homo sapiens
  Payload ID: 2760
  Gene Symbol: CERS5
  Gene Name: ceramide synthase 5
  ENST ID: ENST00000547787
  CDS Start-End: 7-228
cgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagagatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaaccc

SEQ ID NO: 116734 - DNA, 565 bp, Homo sapiens
  Payload ID: 2760
  Gene Symbol: CERS5
  Gene Name: ceramide synthase 5
  ENST ID: ENST00000547455
  CDS Start-End: 73-354
ctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcggtggtgttttgctcttgtcgcccaggctggagtccaatggtgcagtcacagctcactgcaacctctgcctcccaggttcaaatgattctcctgcctcagccttccaagtagctgggattatggatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaat

SEQ ID NO: 116735 - DNA, 825 bp, Homo sapiens
  Payload ID: 2760
  Gene Symbol: CERS5
  Gene Name: ceramide synthase 5
  ENST ID: ENST00000547800
  CDS Start-End: 47-825
cggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctg

SEQ ID NO: 116736 - DNA, 558 bp, Homo sapiens
  Payload ID: 2760
  Gene Symbol: CERS5
  Gene Name: ceramide synthase 5
  ENST ID: ENST00000549389
  CDS Start-End: 32-313
gtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcggctggagtgtagtggcgcgatctcactgcaaccttcgactccctggttcaagcgattctcctgcctcagcctcccgagtagctaggattacagatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcat

SEQ ID NO: 116737 - DNA, 2260 bp, Homo sapiens
  Payload ID: 2760
  Gene Symbol: CERS5
  Gene Name: ceramide synthase 5
  ENST ID: ENST00000551697
  CDS Start-End: 6-1061
gtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctgtttttctgttctattctattctactttcgccaatagaacacaagaaccctattgccctgcttttaccttagcctgtgctgaccttctgtggactctcataggacctctgctgcctcagaccgtatttctagcaaggtcggatccagactcagagtacccggcttggttggcttctcaggactgactcatctctgaggaacagtcctcattttatgcctaagattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtgacctgtccaggaaggattagaccctgtactctccactctttcctcacctccttccttttttctatgcctggcgggagctggacagtttcatctcttgcatgtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaacccacctcta

SEQ ID NO: 116738 - DNA, 1077 bp, Homo sapiens
  Payload ID: 2760
  Gene Symbol: CERS5
  Gene Name: ceramide synthase 5
  ENST ID: ENST00000550919
  CDS Start-End: 1-235
ctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaaccca

SEQ ID NO: 116739 - DNA, 578 bp, Homo sapiens
  Payload ID: 2760
  Gene Symbol: CERS5
  Gene Name: ceramide synthase 5
  ENST ID: ENST00000550899
  CDS Start-End: 73-306
ctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgggttcaagcaattctcctgcctcagcctcccaagtagctgggattacaggcgcccaccaccacgcccagataatttttttttgtatttttagtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagagattctgattttgcaag

SEQ ID NO: 116740 - DNA, 7217 bp, Homo sapiens
  Payload ID: 2761
  Gene Symbol: CERS6
  Gene Name: ceramide synthase 6
  Uniprot ID: Q6ZMG9
  ENST ID: ENST00000305747
  CDS Start-End: 588-1742
agggctggttctgaagcttggcggcagcccctacctgctgacccaccgcctccgggcgcacgggaagaggactgagagccctgaaaccccagcggggcaggagccagcattctgagcatgtgcgagccagccagggggctagggcggatttggggggtcgactttaggtcgtcgccctaagcgcaaagcgaaagagcggtgagagcaggggcgggcgacactccccggagcggtgcccctgcgcccagggcgcagcgactgcgccctgccctgcgggtgtgggcgagttggccgcgtgtgtgcctcgctgtttgacgcgaagacgagccaatcagggcgggcggcccgagctgccatgtgacgggcaaggcggcccctttccccagcgcggccagagggaggagagaaccggggctcgccgcgagccttcgagagcagcggccgcggaggaggcggcggcggcgggcgggagcagcggcggcggcggcacaggctcggggccagccgggcgcgcatccccgggcgccctgcgcggtggagagcttggcgggctgcgggtgccgcaggacaggagtggacaaagcaagatggcagggatcttagcctggttctggaacgagaggttttggctcccgcacaatgtcacctgggcggacctgaagaacacggaggaggccaccttcccgcaggctgaggacctctatctcgcttttcccctggccttctgtatcttcatggtgcggctcatcttcgagagatttgtagccaaaccgtgcgccatagccctcaacattcaggccaatggaccacaaattgctccgcccaatgccattctggaaaaggtcttcactgcaattacaaagcatcctgatgaaaagagattggaaggcctctccaagcaactggactgggatgttcgaagcattcagcgctggtttcgacaaagacgcaatcaggagaagccaagcacgctgacgaggttctgtgagagcatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgtggacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagagtgcagtg

SEQ ID NO: 116741 - DNA, 6851 bp, Homo sapiens
  Payload ID: 2761
  Gene Symbol: CERS6
  Gene Name: ceramide synthase 6
  Uniprot ID: Q6ZMG9
  ENST ID: ENST00000392687
  CDS Start-End: 201-1379
gcggccagagggaggagagaaccggggctcgccgcgagccttcgagagcagcggccgcggaggaggcggcggcggcgggcgggagcagcggcggcggcggcacaggctcggggccagccgggcgcgcatccccgggcgccctgcgcggtggagagcttggcgggctgcgggtgccgcaggacaggagtggacaaagcaagatggcagggatcttagcctggttctggaacgagaggttttggctcccgcacaatgtcacctgggcggacctgaagaacacggaggaggccaccttcccgcaggctgaggacctctatctcgcttttcccctggccttctgtatcttcatggtgcggctcatcttcgagagatttgtagccaaaccgtgcgccatagccctcaacattcaggccaatggaccacaaattgctccgcccaatgccattctggaaaaggtcttcactgcaattacaaagcatcctgatgaaaagagattggaaggcctctccaagcaactggactgggatgttcgaagcattcagcgctggtttcgacaaagacgcaatcaggagaagccaagcacgctgacgaggttctgtgagagcatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggctgggaagtggaaccctttacatgtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgtggacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagagtgca

SEQ ID NO: 116742 - DNA, 2190 bp, Homo sapiens
  Payload ID: 2762
  Gene Symbol: CPTP
  Gene Name: ceramide-1-phosphate transfer protein
  Uniprot ID: Q5TA50
  ENST ID: ENST00000343938
  CDS Start-End: 412-1056
gagggcggggcgagggcggggcggtgggcggggacggggcccgcacggcggctacggcctaggtgagcggctcggactcggcggccgcacctgcccaacccaacccgcacggtccggaagtcgccgaggggccgggagcgggaggggacgtcgtcctagagggccggagcgggcgggcggccgaggacccggctcccgcgcaggacggagccgtggctcaggtcggcccctccccaacaccaccccgggcctccgccccttcctgggcctctcggtggagcagggacccgaaccggtgcccatccagtccggtgccatctgaagcccccttcccagaaaatgagccacagagcaagctgaccccagcgacacagccccccagccctactgtatttccgttcctatcaaaaaatggatgactcggagacaggtttcaatctgaaagtcgtcctggtcagtttcaagcagtgtctcgatgagaaggaagaggtcttgctggacccctacattgccagctggaagggcctggtcaggtttctgaacagcctgggcaccatcttctcattcatctccaaggacgtggtctccaagctgcggatcatggagcgcctcaggggcggcccgcagagcgagcactaccgcagcctgcaggccatggtggcccacgagctgagcaaccggctggtggacctggagcgccgctcccaccacccggagtctggctgccggacggtgctgcgcctgcaccgcgccctgcactggctgcagctgttcctggagggcctgcgtaccagccccgaggacgcacgcacctccgcgctctgcgccgactcctacaacgcctcgctggccgcctaccacccctgggtcgtgcgccgcgccgtcaccgtggccttctgcacgctgcccacacgcgaggtcttcctggaggccatgaacgtggggcccccggagcaggccgtgcagatgctaggcgaggccctccccttcatccagcgtgtctacaacgtctcccagaagctctacgccgagcactccctgctggacctgccctaggggcgggaagccagggccgcaccggctttcctgctgcagatctgggctgcggtggccagggccgtgagtcccgtggcagagccttctgggcgctgcgggaacaggagatcctctgtcgcccctgtgagctgagctggttaggaaccacagactgtgacagagaaggtggcgaccagcccagaagaggcccaccctctcggtccggaacaagacgcctcggccacggctccccctcggcctattacacgcgtgcgcagccaggcctcgccagggtgcggtgcagagcagagcaggcaggggtgggggccgggcctgcaagagcccgaaaggtcgccaccccctagcctgtggggtgcatctgcgaaccagggtgaagtcacaggtcccggggtgtggaggctccatcctttctcctttctgccagccgatgtgtcctcatctcaggcccgtgcctgggaccccgtgtctgcccaggtgggcagccttgagcccaggggactcagtgccctccatgccctggctggcagaaaccctcaacagcagtctgggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggcaccagttccccgagggacgcagcaggccgcctcccgcagcggccgtgggtctgcacagcccagcccagcccaaggcccccaggagctgggactctgctacacccagtgaaatgctgtgtcccttctcccccgtgccccttgatgccccctccccacagtgctcaggagacccgtggggcacggaacaggagggtctggaccctgtggcccagccaaaggctaccagacagccacaaccagcccagccaccatccagtgcctggggcctggccactggctcttcacagtggaccccagcacctcggggtggcagagggacggcccccacggcccagcagacatgcgagcttccagagtgcaatctatgtgatgtcttccaacgttaataaatcacacagcctcccaggagggagacgctggggtgcac

SEQ ID NO: 116743 - DNA, 783 bp, Homo sapiens
  Payload ID: 2762
  Gene Symbol: CPTP
  Gene Name: ceramide-1-phosphate transfer protein
  ENST ID: ENST00000488011
  CDS Start-End: 431-783
cctgaccttgggccgttgggctgccctgggaaaggcctggaggtgtcctgggtcaccttcctgggctggcaagctgcctgcctcctgcacagccactgcccttcctgttgttaccgagccaccagccacagctctgagaagctcctggcagcttctgtttgccactggctcgaatctgggcaggaaggcaaggcccgcagaatatctggtgaccaagaaggaaaccccagagcctcagagaccatcttctcagtggacaaaattaaggcccgaggaggggaggggcgtgctggaagtctatgggactgcatctttctgaggcccaggagcagccatcccccacacctgaagcccgaaaatgagccacagagcaagctgaccccagcgacacagccccccagccctactgtatttccgttcctatcaaaaaatggatgactcggagacaggtttcaatctgaaagtcgtcctggtcagtttcaagcagtgtctcgatgagaaggaagaggtcttgctggacccctacattgccagctggaagggcctggtcaggtttctgaacagcctgggcaccatcttctcattcatctccaaggacgtggtctccaagctgcggatcatggagcgcctcaggggcggcccgcagagcgagcactaccgcagcctgcaggccatggtggcccacgagctgagcaaccggctggtggacctggagcgccgctcccaccacccggagtctggctgccggacggtgctgcgcctgcaccgcgccctgcactggct

SEQ ID NO: 116744 - DNA, 1215 bp, Homo sapiens
  Payload ID: 2763
  Gene Symbol: CER1
  Gene Name: cerberus 1, DAN family BMP antagonist
  Uniprot ID: O95813
  ENST ID: ENST00000380911
  CDS Start-End: 46-849
ctttgggcctcatcatttacaaaagaagcttgggcccctgacagcatgcatctcctcttatttcagctgctggtactcctgcctctaggaaagaccacacggcaccaggatggccgccagaatcagagttctctttcccccgtactcctgccaaggaatcaaagagagcttcccacaggcaaccatgaggaagctgaggagaagccagatctgtttgtcgcagtgccacaccttgtagccaccagccctgcaggggaaggccagaggcagagagagaagatgctgtccagatttggcaggttctggaagaagcctgagagagaaatgcatccatccagggactcagatagtgagcccttcccacctgggacccagtccctcatccagccgatagatggaatgaaaatggagaaatctcctcttcgggaagaagccaagaaattctggcaccacttcatgttcagaaaaactccggcttctcagggggtcatcttgcccatcaaaagccatgaagtacattgggagacctgcaggacagtgcccttcagccagactataacccacgaaggctgtgaaaaagtagttgttcagaacaacctttgctttgggaaatgcgggtctgttcattttcctggagccgcgcagcactcccatacctcctgctctcactgtttgcctgccaagttcaccacgatgcacttgccactgaactgcactgaactttcctccgtgatcaaggtggtgatgctggtggaggagtgccagtgcaaggtgaagacggagcatgaagatggacacatcctacatgctggctcccaggattcctttatcccaggagtttcagcttgaagagctatcccactattacctttgaaaagcaaaaccacaacagcaaagatgctgattattcagtctgaaaatgttaagtgggtacataacattttcagggaaaggtgacttgaaacgtagttttaaattagaacgatagaggaaatgatattagtctagttattggtacacgtttgagaccttgtctcagctctgccactaactagccgtagaatgttaagttgtaaaacctttctccatctaaagattttcatctataaatgacggacccgacctagatgattgctaaaatcctttccactactaatattccgtgatgcattttctccaagtttgggtaaaagccctccatctaaagaaggaaaa

SEQ ID NO: 116745 - DNA, 2467 bp, Homo sapiens
  Payload ID: 2764
  Gene Symbol: CDR1
  Gene Name: cerebellar degeneration-related protein 1, 34kDa
  Uniprot ID: P51861
  ENST ID: ENST00000370532
  CDS Start-End: 506-1294
ctgttggttcataagatctggtctataaggaggaatgtcccattaaatgtttttgaagctaattcaactagaagcagaaatagttgagttggaagatttttctgtagagtgattttaacatgggaaggctcagacaggggaagcctagatttgaaaaggcctggacctggggaaaggctggaagatctggactatagaacatgttagaatacctggatattgcagacactggaagacctgaatgtcagaagatcagcacactggagacgttggaagacatggatattgagccagttgatggaagactgggtagttgttggaagacatgaagatgctggaagacacagagatgctggaagacgtggagatgttggaagacgagcagatgctggaagccctggagatgctggaagacctggagatataggaagacatggatttgttggaagacgtagcttagttggaagacatatattttctggaagacgtggattttctggaagacatggcttggttggaagacgtggattttctggaagacgtacctttgttggaagacatacctttgttggaagacgtacctttgttggaagacgtacctttgttggaagacacaagtaggctggaagacattaatttgatggaagacatggctttgttggaagacgtggatttgctggaagacacggatttcctggaagacctggatttttcggaagctatggatttgagggaagacaaggattttctggaagacatggatagtctggaagacatggctttgttggaagacgtggacttgctggaagacacggatttcctggaagacccggattttttggaagctatagatttaagggaagacaaggattttctggaagacatggatagtctggaagacctggaggccattggaagatgtggattttctggaagacatggcttttttggaagacgtagattttcaggaagacccaaattatccggaagacttggattgttgggaagacgtggattttctggaagactgggaggttactggaagacatggattttctggaagacatggattttctggaagacgtggatcttcaggaagacatatattggctggaagacctggattttttccggaagatgtggattgactggaagacctggatttggtggaagacgtagatttttctggaagacactgactgactggaagacctggatttctttctggaagacactgattgactggaagacctggatttctttctggaagacactgattgactggaagatctagatttttctggaagaactagatttactggaagacttggatttggtggaagacacagatttttctggaagacatggattagctggaagatctgtatttgatggaagaccttgaaattattggaagacatggatttcctggaagacgtggattttcctggaagatctggatttggtggaagaccagtaattgctggaagactggatttgctggaagacttgatttactggaagacttggagcttcttggaagacatggattgtccggaagacatggattgtctggaagatgtggattttctggaagctcaggattatctggaagaccttgagattattggaagacttgaagtcgctggaagacccggagttgttggaagaccttgacacaggtgccatcggaaaccctggacattggaaacattgtaagcacaggatattggagacattgcaagccttggattttgaagacattggttactctggacattgatatttctggaggccctgaacattgggatattgaatattggaagtcatagacactgaaatctctggaaattagagatattgtaagtcctgtaccttggaactcctaaatactggcagatataaacaacagcagatgtagacatttataaatcctaaaatgagaagccctggatattgggagacattggtaagcatggatattgacatatttatgtcaaaaagacagtttggaagaattaaattttaaagatgctggatgtcaagaatactggcagcctggacaatatgagaccaggatattaagaggtctattcattcagacattgaggatattgatgtacctgaaagttcttgcaggtatttaaagacttgggcattggaggaattggcgataaaaatacactgtaaaactagaaagtaggagacatttaaaaatgtaaaaactgaatgatgtaagtgctggaagacattgaagaatctagacttaaacactatgaaatacatagcctctagaagacctgtatataggagacattggaggattaggaccatggaagacttgtaatttagaactctggattctgaaagacaagacctggactttgaagatgggttgttggagatattagaagacctaaatttttaatgacttgaatactgggaagtttagaaaacaagggcattg

SEQ ID NO: 116746 - DNA, 2702 bp, Homo sapiens
  Payload ID: 2765
  Gene Symbol: CDR2
  Gene Name: cerebellar degeneration-related protein 2, 62kDa
  Uniprot ID: Q01850
  ENST ID: ENST00000268383
  CDS Start-End: 309-1673
gccaaagtgccacgttgggcccggcggcggcgtgaagactggcggctgcgtgagactccggctccaggcgttcgcaccgtaatgcccggccgttggggccgtcggtaggcgcgaggcgagtcgaggcagccggccggtcggcggccgccggcgggaacggggctgaggcggcgcagcggagtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaagatcttcaacttgctgctgagcttgggaagacattactggatcggaacacagagttggaggactctgttcagcagatgtatacaaccaatcaggagcagttacaggaaattgagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccaacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaactggagcagcagctgggggccacaggtgcctaccgagcacgggcgctggaactagaggccgaggtggcagagatgcgacagatgttgcagtcagagcatccatttgtgaatggagttgagaagctggtgccagactctctgtatgttcctttcaaagagcccagccagagcctgctggaagagatgttcctgactgtgccggaatcacatagaaagcctctcaagcgcagcagcagtgagacgatcctcagcagcttggcagggagtgacatcgtgaagggccacgaggagacctgcatcaggagggccaaggctgtgaaacagaggggcatctcccttctgcacgaagtggacacgcagtacagcgccctgaaggtgaagtatgaagagttgctgaagaagtgccaagaggaacaggactccctgtcacacaaggctgtgcagacctccagggctgcagccaaggacctgactggagtgaacgcccagtctgagcctgttgccagcggctgggaactggcctctgtcaacccagagcccgtgagttcccctacaacacctccagaatacaaagcgttgtttaaggagatctttagttgcatcaagaaaactaagcaggaaatagatgaacagagaacaaaataccgatcactctcctctcattcttaattgaacctctagctctactactaatttgcctattgcctatcgcctctctctcccattcagacaagtgtttgtagactctgaagcctaatgttactcatgacgtttgcctcattgctttgcttatttagcaaatgcatacaacgaggaaaggaggtggctagtggtatcagttctctgatccacttccatttaagctccccaggaaatcccatgacaaactggcctctggctggcgcgctgattagacttcagttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacagtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaa

SEQ ID NO: 116747 - DNA, 556 bp, Homo sapiens
  Payload ID: 2765
  Gene Symbol: CDR2
  Gene Name: cerebellar degeneration-related protein 2, 62kDa
  ENST ID: ENST00000563573
  CDS Start-End: 369-556
tatatgtttacctacatcctacatgcttctaaaagatgttgtatgaactagtaggatgaggttttatcacaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtc

SEQ ID NO: 116748 - DNA, 711 bp, Homo sapiens
  Payload ID: 2765
  Gene Symbol: CDR2
  Gene Name: cerebellar degeneration-related protein 2, 62kDa
  ENST ID: ENST00000561630
  CDS Start-End: 129-269
gtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccaacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaa

SEQ ID NO: 116749 - DNA, 567 bp, Homo sapiens
  Payload ID: 2765
  Gene Symbol: CDR2
  Gene Name: cerebellar degeneration-related protein 2, 62kDa
  ENST ID: ENST00000567406
  CDS Start-End: 218-567
agagtcaagatgcgagaaggggtggccgggcggcggacctcaggcttccggcacccttgcgcttcccgccggcacgaaggactcccctggacaaccgcccgcctctcagaggccggagtcctaggccctccggcctgcgttgcctgtccacagacgcgccggcctcgggacacccaccacagggtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccaacacttcgtgtatgatcatgtgttcgctgagaagatcacttccttgcaaggtcagccaagccctgatga

SEQ ID NO: 116750 - DNA, 1056 bp, Homo sapiens
  Payload ID: 2765
  Gene Symbol: CDR2
  Gene Name: cerebellar degeneration-related protein 2, 62kDa
  ENST ID: ENST00000564542
  CDS Start-End: 355-1056
agcacgttggttaagatggtgagcagctcaaagagtgaggatggatgaagcaaagcagaggccgctgcccctgtaagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagagacctgcctttcgccttctgccatgattgggaggcctccccagccacatggaactatcttcaacttgctgctgagcttgggaagacattactggatcggaacacagagttggaggactctgttcagcagatgtatacaaccaatcaggagcagttacaggaaattgagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccaacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaactggagcagcagctgggggccacaggtgcctaccgagcacgggcgctggaactagaggccgaggtggcagagatgcgacagatgttgcagtcagagcatccatttgtgaatggagttgagaagctggtgccagactctctgtatgttcctttcaaagag

SEQ ID NO: 116751 - DNA, 361 bp, Homo sapiens
  Payload ID: 2765
  Gene Symbol: CDR2
  Gene Name: cerebellar degeneration-related protein 2, 62kDa
  ENST ID: ENST00000567010
  CDS Start-End: 1-242
cagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccagtaagagcctgcctttctgtggagttacagcagggactgtctcatgtcattggcacattctgatttccagtagattgaaagtaccattttaagaaaagtcacttagctattaagctaccattg

SEQ ID NO: 116752 - DNA, 3536 bp, Homo sapiens
  Payload ID: 2766
  Gene Symbol: CDR2L
  Gene Name: cerebellar degeneration-related protein 2-like
  Uniprot ID: Q86X02
  ENST ID: ENST00000337231
  CDS Start-End: 413-1810
aagatgcagcggcggctccggttgtcgccgggcgggccaggagcagcgcggacccgagccgggcagggggcgcccgccacggcacccgcgcgctcctagcgccccagacccgcctgcgggcccggatcctccttgccactgtcccacccgccgtccctgccactccaccctttgtgtcgccgcagcccggtgcccccggctctgcgggaccccggccgggccggaccctggcaaagcgccaggccccgcgtgggctcccggcgagcggttgatggcgagggggcgcggcgcgggctctgtagcccgagttcccgacgctggaggcccggcccgcctcagccgcattgtcccgggccgcgcgcaccggccctgagctgcgccgccgcagcacccgcccgccgcccgcggggccatgcggagagccgccgggatggaggacttctccgcggaggaagaggagtcctggtacgaccagcaggacctggagcaggacttgcacctagctgcggagctggggaagactctgctggagaggaacaaggagctggaggggtccctgcagcagatgtactccaccaatgaggaacaggtgcaggagatcgagtacctaaccaagcagctggacacgctgcggcacgtgaacgagcagcacgccaaagtctatgagcagctggacctgacagcccgggacctggagctgaccaaccacaggctggtgctggagagtaaggctgcccagcagaagatccatgggctgacggagaccattgagcgcctccaggctcaggtggaggagctgcaggcccaggtggagcaactgagaggcctggaacagctgcgagtgctccgggagaagcgggaacgcaggcgtaccatccacaccttcccctgcctcaaggagctgtgcaccagcccccggtgcaaggatgctttccgcctacacagttcctccctggagctgggcccgcggcccctggagcaggagaacgagcggctgcagaccctggtgggggcgctgcgctcccaggtgagccaggagcggcagcgcaaggagcgggcggagcgcgagtacaccgcggtgctgcaggagtactcggagctggagcgccagctgtgcgagatggaggcctgtcgcctgcgtgtgcaggagctggaggccgagctgctggagctgcagcagatgaagcaggccaagacctacctactgggtccggacgaccacctggccgaggccctgctcgcacccctcacgcaggcccctgaggccgacgatccccagcccggccgcggggacgacttgggcgcccaggacggggtctcctcaccggcagcctctccaggccacgtggtgcgcaagagctgcagcgacactgcgctcaacgccatcgtggccaaagacccagccagccggcacgcgggcaacctcacactgcacgccaacagcgtgcgcaagcggggcatgtccatcctgcgggaggtggacgagcagtaccacgcgctgctggagaagtacgaggagctgctgagcaagtgccggcagcacggggccggagtgcggcacgccggcgtgcagacctcgcgccccatctcccgggacagctcgtggagggacctgcgcgggggtgaggagggccagggtgaggtcaaggcaggagagaagagcctgagccagcacgtggaggccgtggacaagcggctggaacagagccagcccgagtacaaggcgctcttcaaagagatcttctccaggatccagaagaccaaggctgacatcaacgccaccaaagtcaagacgcacagcagcaagtgacccttctccggcctgcagcctcccccagggtggaagccgtggggtccctcaggcctgggcggtgcagcttccagagagcgagcgccctttagcggcctgccaccacagcacgcggcctcctgatccggaagcacgcagcatgttccctgctgagcggaggcagcccacctgtcctgcctcccaggagcccttggccacctcgcgccagcccaaaggcgcagctctgagttcaaagccaaatgtccccactaccccagggatcccccagctcccccagcccctggcttcctgaccctgcgcctcaccctcagactggtgaccaggcttctgaaagccattctggatcagttggctttttttttttttttggttaagtttgttttttctaagagatttgcaatgcaaggtctccttgaccccttgccacaactggaaacacttgaaaggggaccccagggccagctgtttcaggggtttcctggaccacccactgcttctccccaaccctgatgcgctgacattcccttagcaccagctgtcccacctccagggtcctgaccaggtcagagatgtcccctgccatgcagagcaggaagcctcagctgggcctggagtgtccctgctccagccctgccagggacaggtttctccctggatactcttggcccaccgcagatctgtagccagtcagaggaggaggagaaggagcccctcagcagagtggtgcagtttcgctcagagcttgtctccttggcttccaaccccagaaatgcctgctgggccttaagctttccaggggccggggcagtggggagcccccatcccttcacaccgccaccaactaaccaagcttggcctctgactcccgtctctgtgcttgcccccatctcagggaccatgatgtctcagtcactccacgctccccacaggccaaccctggcacaggtcatgtctgcagcccccagaatgttctggacatgcaccaccagccggtggtcccaatgtccacccctgcctccccttcactggggactggggttttcgccccatgctgcatcgtgttgtattgggatggggctgaggaacatgctccctccctccctcccataaaatgcctgctcttcacctcccacctttgtggggggcttttgaggacccagctgcgtcaggagttttgcttcaagatgtcagaaagtcaagttcagctaagagacacccaggtccccagcttgccctgagcagcccttcagggcttctggttccttctgccgcccttcctgagaccttagaaaccagaagagccatacagtcagtggaaggcgggggggccctggcctctgcaccgggatcccagtgggaaccttcatgccttatttatttctaatgggtaaaggggttttcttaccaagcatccctgacctcctggagacaccacctgctttccgggcggcactgtgatgggagctggtggcgactgagtccttctgtacgtgcaactgggaaacttttgtcctttgaggctaggcagctccctgccctccgtgtgtgtctgttatctgggggagaggagtgtggaagggttgggggaagagctccagcctgtctgctccccagctctgtagtggcagaccagcgtcacctttgaagtatacgtgagagaaatatatttacaaatgctttattctcttctttaataaaaaatgcaccagtattctaaaagcaaaaa

SEQ ID NO: 116753 - DNA, 2435 bp, Homo sapiens
  Payload ID: 2767
  Gene Symbol: CBLN1
  Gene Name: cerebellin 1 precursor
  Uniprot ID: P23435
  ENST ID: ENST00000219197
  CDS Start-End: 367-948
cgctccggctgcagcgccggctgcatcaataattcagagcggcggcggcggcggcagcggcgggtgcgggcaggaggcggcggcagcagcgggaccgagcagcagcggctatgcatccaagtgcggctgggcagccgcggcacccctgaggcccgggaggggctccgggaacacagcgcggaggggacgctagtcgcggaggggacgctagtcccggagtgcgaggaagaggtgtagtgtccagagcggcggcggcggagctgcgcacggagctgaggagggggcttcggagcgggactgggacggggggggcggctggcgcgagcagccctgggggtggggggcggggtgggcgccggcggcgcgatgctgggcgtcctggagctgctgctgctgggggctgcgtggctggcgggcccggcccgcgggcagaatgagacggagcccatcgtgctggagggcaagtgcctggtggtgtgcgactccaaccccacgtccgaccccacgggcactgccctgggcatctctgtgcgctctggcagcgccaaggtggctttctctgccatcaggagcaccaaccacgagccgtccgagatgagtaatcgcaccatgatcatctacttcgaccaggtactagtgaacattgggaacaactttgattcagaacgcagcactttcatcgccccgcgcaaagggatctacagttttaacttccacgtggtaaaagtctacaacagacaaaccatacaggtgagcctcatgctaaacgggtggccggtgatttcagccttcgctggtgaccaggacgtgacccgggaggccgccagcaacggagtcctaatccaaatggagaaaggcgaccgagcatacctcaagctggagcggggaaacttgatggggggctggaagtactcgaccttctccggattcctggtgtttcctctctgactggctcgtagccggaagggaggcagggagagggcgaaggcaggaaggggagtgagaaagaggctgaaattaagagggcgagaaagcagcacgacttgaaacttcctacatgttctctaactgtatctgggtaaaaaggtgcgcgccagctgtgggacaactttgtccatttccttattaggagaaataaatttcgcttagctctgcgcactcccatttccaaaaataaactcgcctcccccattccagttgcagtaatcaagaaagagactgccttgtcattgtttcttatcccccaacttcatgttccctgcaatttatttaaagaaactttgtatttcactacataatctgaaatctttctccctagccccctctgaatccttctgcctactgaaatctgatatattacacacccccaaccttttttttttcagtttggaaaggggtaaagttttgttgttgttgttgttttgttttggatggggaaggtagttttaatttggcaagtgttgctcttcttaaaacactgctcaaattaattagctgaagatacttagtatcctcggctgcttgttagcagagaaaggactcaccttagtggtgactggtttaaaaaatataaatatatatcatttgtatacgaagaactcttcccagtggaaactggctgtgtttccgtatttctatgttctattcggagtgatcgtgaaatctaaggctgcttgatgttctgatgcttgtcaatgccgtcgtgctctgtgactccacgaaacgccaaggagcttcttccggacgcctcctcttcctctgtaacatacgtgtgaatagtcaaggtttaattttgctttaatctaataaagtcgaagtgggacttttatttttctgaaacagctttctaaaatccgcatcttccccagctgcgaggttgggggtctggggtgccaaagggcgaggttccgaaaggcaggagacttgggggaacgcaaccatagaaaggcctgggcgcgagggcttccttgcaaagccggccttgcgctccttcctgcgccaggccggggaccagcactgcattcgcctgtgttcacagctttggcggaaacgtaagaaatgtggccgaaatcttgctaggccaggcgcggccgccggcccaggagcgaagtttgatttttttctttgcattccaaatgcatcaggaatagtcccagtttgaggacccaaacgaccctgcctggagcggcagactcctcaggccttctgtccccggatgtctcccaccgcgtccccctcgcagttcccgaagcagcgtatgttttatacaccgcctctgaatccggagtccacccgccgcatactcgggcgcccaggacctatgattccgctcattcacaggactttattcaagaggttcgtccaggagttttgattgtatcggaacataatgtgaaagcaaaaatgaaataaacgacttcgttttaagtctgaaa

SEQ ID NO: 116754 - DNA, 718 bp, Homo sapiens
  Payload ID: 2767
  Gene Symbol: CBLN1
  Gene Name: cerebellin 1 precursor
  Uniprot ID: P23435
  ENST ID: ENST00000536749
  CDS Start-End: 45-626
gagctgaggagggggcttcggagcgggactgggacggcggcgcgatgctgggcgtcctggagctgctgctgctgggggctgcgtggctggcgggcccggcccgcgggcagaatgagacggagcccatcgtgctggagggcaagtgcctggtggtgtgcgactccaaccccacgtccgaccccacgggcactgccctgggcatctctgtgcgctctggcagcgccaaggtggctttctctgccatcaggagcaccaaccacgagccgtccgagatgagtaatcgcaccatgatcatctacttcgaccaggtactagtgaacattgggaacaactttgattcagaacgcagcactttcatcgccccgcgcaaagggatctacagttttaacttccacgtggtaaaagtctacaacagacaaaccatacaggtgagcctcatgctaaacgggtggccggtgatttcagccttcgctggtgaccaggacgtgacccgggaggccgccagcaacggagtcctaatccaaatggagaaaggcgaccgagcatacctcaagctggagcggggaaacttgatggggggctggaagtactcgaccttctccggattcctggtgtttcctctctgactggctcgtagccggaagggaggcagggagagggcgaaggcaggaaggggagtgagaaagaggctgaaattaagagggcgagaaagcagcac

SEQ ID NO: 116755 - DNA, 872 bp, Homo sapiens
  Payload ID: 2767
  Gene Symbol: CBLN1
  Gene Name: cerebellin 1 precursor
  ENST ID: ENST00000564786
  CDS Start-End: 18-440
tgggcgccggcggcgcgatgctgggcgtcctggagctgctgctgctgggggctgcgtggctggcgggcccggcccgcgggcagaatgagacggagcccatcgtgctggagggcaagtgcctggtggtgtgcgactccaaccccacgtccgaccccacgggcactgccctgggcatctctgtgcgctctggcagcgccaaggtggctttctctgccatcaggagcaccaaccacgagccgtccgagatgagtaatcgcaccatgatcatctacttcgaccaggtgagtgttccttcctcccgcggcgtgcagattgggctggtgaaggagggatggatggaagaccgatgcccggtcctctccaagggctctgcggaggcgcggggacgacagtccgggaccgattcctgcccactccccttcgttcccgtctcgttataggtactagtgaacattgggaacaactttgattcagaacgcagcactttcatcgccccgcgcaaagggatctacagttttaacttccacgtggtaaaagtctacaacagacaaaccatacaggtgagcctcatgctaaacgggtggccggtgatttcagccttcgctggtgaccaggacgtgacccgggaggccgccagcaacggagtcctaatccaaatggagaaaggcgaccgagcatacctcaagctggagcggggaaacttgatggggggctggaagtactcgaccttctccggattcctggtgtttcctctctgactggctcgtagccggaagggaggcagggagagggcgaaggcaggaaggggagtgagaaagaggctgaaattaagagggcgagaaagcagcacgacttgaaacttcctacatgtt

SEQ ID NO: 116756 - DNA, 2945 bp, Homo sapiens
  Payload ID: 2768
  Gene Symbol: CBLN2
  Gene Name: cerebellin 2 precursor
  Uniprot ID: Q8IUK8
  ENST ID: ENST00000269503
  CDS Start-End: 775-1449
gtcttctgtcggagtccgccggtccgcagcctgcggcagggaggcccgggcacccgcaggtggcgccccacgtccgtgtttgcgccctcagccgagctccaggcgcagctgggaaacccagcgcgtctccccgggtcctttgagcgagcgcggacaccgcaatttaataaataagcgcaagcgccagccgctccaccagtccgaggtccagaggagcagacacacagacccgggccggaggcccctcttctagccctgcgggaaccggacagttccccaactgggactctggaaccacagctcctaaatcatcaaattctcaagctttttttttccctctcttcgtcccagccatcccagtcttcttcttcttttttttttttttaacttattgtttttttcgctcctgtcattatgaaagtggtcacgccattcaatattaagacttggagggaattggggaaagaaaagaaagaatctaaaagaagagaagcgaccggtgcttttaagggtgtctaattttcaaaagagacgtctgggagtattttgctctgggcgtttggagcaacttcgcggacagcggagctcgcccagcatggatgttccaggttcacaggcgcctttcttctgagaacgaccctggccttgaacgtcagagccggggacgaaggcccccggaggctgctgcgagctccgcgcgttccttcgcgcccttccgcgccgctcgcgccggcgccggcctccacccccgcgcgccgcctcccaccagtcccgatgcaggcgcccggccgggggccactcgggctgcggctgatgatgcccgggcgccggggggcgctgcgcgagccgggcggctgcggatcctgcctgggggtggcgctggccctgctgttgctgctactgcccgcctgctgccccgtgcgggcgcagaacgacacggagcccatcgtgctggagggcaagtgcctggtggtgtgcgactccagcccgtcggcggacggcgccgtcacctcctccctaggcatctccgtgcgctccggcagcgccaaggtggccttctccgccacgcggagcaccaaccacgagccgtccgagatgagcaaccgcaccatgaccatctatttcgaccaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttttgtttttgttttttggaatactgacaattcctcgggaacctggcctctaattagttttagatgacaaggtcttaaggagaaatgaaattatcgatttgagcaatttgtacctgtgattgtaaagtcaatatcggattttattgttgggaccatggacctcttttgtttgtatgttgtattgtcgtcccaacggaaggagagctcctgactccaggatgggctgcaggttgcagtcagggcttgaagtaggagcccagcaaagaaccacctgctggacagtccttgacatgtgttctgtgtgtgtctgtatagccttaagaaaaagaatggcttcactttcattctgtattcttccccccaccatgtggctgggaggacttgggagggggatggggacattgggaacctgtcaagaagtgctttatccagagaagcaaattttgcacgattggactgcaatttttgttttgtattgtttgtgttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaacctggtgttcctgagtggtcctgaatcatataagttggtaatggaagctgtaatgaccaagtcccctaaacatactatgtctttgccacgtgtgctgtgacttctctgtgggtgatttaatttatttggatccacctctgagtgagcgcacagtgatcaggtgcttcaaagccaacagaccagctcctcttcctccggatcctcttttgatctgcccaggaaagggatgcattgacactctcctgcatgcacctggcgagaagccacctgaaagtcactgtggttaaagatattggtggaggtaccccaggagcactgttacaaatccttcttgttttggcatctcgtacaacattattaagacacagctgagagttgatgggtgtgtaatgcatatgccaaggaaatgtcactaatcccaaagcaatcaaaaaggagacctcaaaccagatgttaatttgttctttgtgtaacaatgtaaccaaaatattgatgataaaagtcataatttaagattcagaataaatgggtttgatgtctggc

SEQ ID NO: 116757 - DNA, 537 bp, Homo sapiens
  Payload ID: 2768
  Gene Symbol: CBLN2
  Gene Name: cerebellin 2 precursor
  ENST ID: ENST00000581073
  CDS Start-End: 179-511
ataagcataaatgttctaagagtgtacaacaggactttgcgtccgtcagtgaggataacaagtctgtcattggatagatcctaagtgaaattagatataaaagagaaatgaattgaatttactggacaacattcttcagatctgctgggacatattttcattttctgtgagtactggaatggattgggacaaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtggggg

SEQ ID NO: 116758 - DNA, 2406 bp, Homo sapiens
  Payload ID: 2768
  Gene Symbol: CBLN2
  Gene Name: cerebellin 2 precursor
  Uniprot ID: Q8IUK8
  ENST ID: ENST00000585159
  CDS Start-End: 236-910
actcgcctcattttctctaagcagagcaacttcgcggacagcggagctcgcccagcatggatgttccaggttcacaggcgcctttcttctgagaacgaccctggccttgaacgtcagagccggggacgaaggcccccggaggctgctgcgagctccgcgcgttccttcgcgcccttccgcgccgctcgcgccggcgccggcctccacccccgcgcgccgcctcccaccagtcccgatgcaggcgcccggccgggggccactcgggctgcggctgatgatgcccgggcgccggggggcgctgcgcgagccgggcggctgcggatcctgcctgggggtggcgctggccctgctgttgctgctactgcccgcctgctgccccgtgcgggcgcagaacgacacggagcccatcgtgctggagggcaagtgcctggtggtgtgcgactccagcccgtcggcggacggcgccgtcacctcctccctaggcatctccgtgcgctccggcagcgccaaggtggccttctccgccacgcggagcaccaaccacgagccgtccgagatgagcaaccgcaccatgaccatctatttcgaccaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttttgtttttgttttttggaatactgacaattcctcgggaacctggcctctaattagttttagatgacaaggtcttaaggagaaatgaaattatcgatttgagcaatttgtacctgtgattgtaaagtcaatatcggattttattgttgggaccatggacctcttttgtttgtatgttgtattgtcgtcccaacggaaggagagctcctgactccaggatgggctgcaggttgcagtcagggcttgaagtaggagcccagcaaagaaccacctgctggacagtccttgacatgtgttctgtgtgtgtctgtatagccttaagaaaaagaatggcttcactttcattctgtattcttccccccaccatgtggctgggaggacttgggagggggatggggacattgggaacctgtcaagaagtgctttatccagagaagcaaattttgcacgattggactgcaatttttgttttgtattgtttgtgttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaacctggtgttcctgagtggtcctgaatcatataagttggtaatggaagctgtaatgaccaagtcccctaaacatactatgtctttgccacgtgtgctgtgacttctctgtgggtgatttaatttatttggatccacctctgagtgagcgcacagtgatcaggtgcttcaaagccaacagaccagctcctcttcctccggatcctcttttgatctgcccaggaaagggatgcattgacactctcctgcatgcacctggcgagaagccacctgaaagtcactgtggttaaagatattggtggaggtaccccaggagcactgttacaaatccttcttgttttggcatctcgtacaacattattaagacacagctgagagttgatgggtgtgtaatgcatatgccaaggaaatgtcactaatcccaaagcaatcaaaaaggagacctcaaaccagatgttaatttgttctttgtgtaacaatgtaaccaaaatattgatgataaaagtcataatttaagattcagaataaatgggtttgatgtctggc

SEQ ID NO: 116759 - DNA, 543 bp, Homo sapiens
  Payload ID: 2768
  Gene Symbol: CBLN2
  Gene Name: cerebellin 2 precursor
  ENST ID: ENST00000584764
  CDS Start-End: 61-387
actcgcctcattttctctaagcagagcaacttcgcggacagcggagctcgcccagcatggatgttccaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttt

SEQ ID NO: 116760 - DNA, 2346 bp, Homo sapiens
  Payload ID: 2769
  Gene Symbol: CBLN3
  Gene Name: cerebellin 3 precursor
  Uniprot ID: Q6UW01
  ENST ID: ENST00000267406
  CDS Start-End: 472-1089
gggctgttgatttgtgggggattttgaagagaggaagagtaggaggaaggggttgaggggctgcctctggcatatgcacacactcacacattctgtcacacccgtcacacacacataccatgttctccatccccccaggtccagccctcagtgctgtcccatccagcagggctgccctgaagctctggctgcagccctcccgtccagtgggcaggcggcttcatccctcctttctctcccaaagcccaactgctgtcactgcatgctctgccaaggaggagggaactgcagtgacagcaggagtaagagtgggaggcaggacagagctgggacacaggtatggagagggggttcagcgagcctagagagggcagacgatcagggtgccggcggtgagaatccagggagaggagcggaaacagaagaggggcagaagaccggggcacttgtgggttgcagagcccctcagccatgttgggagccaagccacactggctaccaggtcccctacacagtcccgggctgcccttggttctggtgcttctggccctgggggccgggtgggcccaggaggggtcagagcccgtcctgctggagggggagtgcctggtggtctgtgagcctggccgagctgctgcaggggggcccgggggagcagccctgggagaggcaccccctgggcgagtggcatttgctgcggtccgaagccaccaccatgagccagcaggggaaaccggcaatggcaccagtggggccatctacttcgaccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggaatctactgggtggttggaaatactcaagtttctctggcttcctcatcttccctctctgaggacccaagtctttcaagcacaagaatccagcccctgacaactttcttctgccctctcttgccccagaaacagcagaggcaggagagagactccctctggctcctatcccacctctttgcatgggaccctgtgccaaacacccaagtttaagagaagagtagagctgtggcatctccagaccaggcctttccacccacccacccccagttaccctcccagccacctgctgcatctgttcctgcctgcagccctaggatcagggcaaggtttggcaagaaggaagatctgcactactttgcggcctctgctcctccggttcccccaccccagcttcctgctcaatgctgatcagggacaggtggcgcaggtgagcctgacaggcccccacaggagcccagatggacaagcctcagcgtaccctgcaggcttcttcctgtgaggaaagccagcatcacggatctcagccagcaccgtcagaagctgaaccagcaccgtatgggctagggtgggaggctcagccacaggcagaagggtgggaagggcctggagtctgtggctggtgaggaaggaaggagggtgtattgtctagactgaacatggtacacattctgcatgtatagcagagcagccagcaggtagcaatcctggctgtccttctatgctggatcccagatggactctggcccttacctccccacctgagattagggtgagtgtgtttgctctggctgagagcagagctgagagcaggtatacagagctggaagtggaccatggaaaacatcgataaccatgcatcctcttgcttggccacctcctgaaactgctccacctttgaagtttgaactttagtccctccacactctgactgctgcctccttcctcccagctctctcactgagttatcttcactgtacctgttccagcatatccccactatctctctttctcctgatctgtgctgtcttattctcctccttaggcttcctattacctgggattccatgattcattccttcagaccctctcctgccagtatgctaaaccctccctctctctttcttatcccgctgtcccattggcccagcctggatgaatctatcaataaaacaactagagaatggtggtcagtgagacactatagaattactaaggagaagatgcctctggagtttggatcgggtgttacaggtacaagtaggtatgttgcagaggaaaataaatatcaaactgtatactaaaattacattttaaaa

SEQ ID NO: 116761 - DNA, 718 bp, Homo sapiens
  Payload ID: 2769
  Gene Symbol: CBLN3
  Gene Name: cerebellin 3 precursor
  ENST ID: ENST00000555436
  CDS Start-End: 70-534
gatgggggagagaaggcgttcaccttggctctgctggcgttttccttggggccctccagctgcagccagatgtgggggttgtccggacagtccttcggaaggacgctcacccccacgctgaagatgcgctccacatggggctgctgttcccgaaccttgttctcagcctccgcagacaccgcaaagcgatctggggacgcggggcgggccccccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggaatctactgggtggttggaaatactcaagtttctctggcttcctcatcttccctctctgaggacccaagtctttcaagcacaagaatccagcccctgacaactttcttctgccctctcttgccccagaaacagcagaggcaggagagagactccctctggctcctatcccacctctttgcatgggaccctgtgccaaacacccaagtttaagagaagagtagagctgtggcatctccagaccag

SEQ ID NO: 116762 - DNA, 3024 bp, Homo sapiens
  Payload ID: 2770
  Gene Symbol: CBLN4
  Gene Name: cerebellin 4 precursor
  Uniprot ID: Q9NTU7
  ENST ID: ENST00000064571
  CDS Start-End: 1302-1907
ggggcgggctcccggccaggcgcggtcgggacgcccgccggtccccaggttcggggcagcgcgcagcgcgggtccgcggcggcttatcctttttcgcgacccggcctggcagcgccgcgctccgcttggagggcactcggcggcagagttccgcgctgggaggggtgaggggaccagccgcctcctctgcggactcagatcgagcaggagagagtgggcgcggagctggggccagcgcagggccgtgggctcctctctgggcacgcatcctttacgccacgggctttcaggggctgaggggcctcgaaccttgccaatcaccagtgctgtgcgccccgcttgctttggggtgcgttaaacgtcaggagagagctgctcagatggggtcaccagacgccttctcccccttttctcggagcccgcgggttgcgcgataagccaacccagccggacgctgcgctcctataaatagagcgcgtgtgcccgcttcgcgctctccgggctgcacgagggacgagaaagttgtgcgcagggactgggggcgggcggccaggcaggagaggaccccgccggaccagccgccctgaacgctgcgcccggcgccctggacctgatcctgcgaatccgcgctttcggtgcgagggacctggctagccgctgcctccctccctacctctgggtgacaccaggtttgggggatttttttgaccaggcgaaagtgggagtcgctggcgtcctggccatgaacacagcctcgcgttcttctcagcctgggaaggaccttctgcctctgtaactcgtccctgccgcaagccagacaggactggcacccgcgccgctgggcacccgccacccttgtggcttctctttgagtcccctctttttgttcctgctccgtggtttagctggtggtgcttgagtttggggtgagaatttattattattattattttttgccttgaggtgtgaatgtgagggtttgatgactttcagatgtctaggaaccagagtgggtgcaggggccccaggcagggctgattcttgggcggaggagagtagggtaaagggtgctgcatgagctccttaaaggacaaaggtaacagagccagcgagagagctcgaggggagactttgacttcaagccacagaattggtggaagtgtgcgcgccgccgccgccgtcgctcctgcagcgctgtcgacctagccgctagcatcttcccgagcaccgggatcccggggtaggaggcgacgcgggcgagcaccagcgccagccggctgcggctgcccacacggctcaccatgggctccgggcgccgggcgctgtccgcggtgccggccgtgctgctggtcctcacgctgccggggctgcccgtctgggcacagaacgacacggagcccatcgtgctggagggcaagtgtctggtggtgtgcgactcgaacccggccacggactccaagggctcctcttcctccccgctggggatatcggtccgggcggccaactccaaggtcgccttctcggcggtgcggagcaccaaccacgagccatccgagatgagcaacaagacgcgcatcatttacttcgatcagatcctggtgaatgtgggtaattttttcacattggagtctgtctttgtagcaccaagaaaaggaatttacagtttcagttttcacgtgattaaagtctaccagagccaaactatccaggttaacttgatgttaaatggaaaaccagtaatatctgcctttgcgggggacaaagatgttactcgtgaagctgccacgaatggtgtcctgctctacctagataaagaggataaggtttacctaaaactggagaaaggtaatttggttggaggctggcagtattccacgttttctggctttctggtgttccccctataggattcaatttctccatgatgttcatccaggtgagggatgacccactcctgagttattggaagatcattttttcatcattggattgatgtcttttattggtttctcatgggtggatatggattctaaggattctagcctgtctgaaccaatacaaaatttcacagattatttgtgtgtgtctgtttcagtatatttggattgggactctaagcagataatacctatgcttaaatgtaacagtcaaaagctgtctgcaagacttattctgaatttcatttcctgggattactgaattagttacagatgtggaattttatttgtttagttttaaaagactggcaaccaggtctaaggattagaaaactctaaagttctgacttcaatcaacggttagtgtgatactgccaaagaactgtatactgtgttaatatattgattatatttgtttttattcctttggaattagtttgtttggttcttgtaaaaaacttggattttttttttcagtaactggtattatgttttctcttaaaataaggtaatgaatggcttgcccacaaatttaccttgactacgatatcatcgacatgacttctctcaaaaaaaaagaatgcttcatagttgtattttaattgtatatgtgaaagagtcatattttccaagttatattttctaagaagaagaatagatcataaatctgacaaggaaaaagttgcttacccaaaatctaagtgctcaatccctgagcctcagcaaaacagctcccctccgagggaaatcttatactttattgctcaactttaattaaaatgattgataataaccactttattaaaaacctaaggttttttttttttccgtagacatgaccactttattaactggtggtgggatgctgttgtttctaattatacctatttttcaaggcttctgttgtatttgaagtatcatctggttttgccttaactctttaaattgtatatatttatctgtttagctaatattaaattcaaatatcccatatctaaatttagtgcaatatcttgtcttttgtataggtcatatgaattcataaaattatttatgtctgttatagaataaagattaatatatgtta

SEQ ID NO: 116763 - DNA, 2206 bp, Homo sapiens
  Payload ID: 2771
  Gene Symbol: CRBN
  Gene Name: cereblon
  Uniprot ID: Q96SW2
  ENST ID: ENST00000231948
  CDS Start-End: 24-1352
gcctcctttgcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcctgtgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccagactaaacttgatactgtattattttgttcaatgtaaattgaagaaaatctgtaagtaagtaaaccttaagtgtgaaactaaa

SEQ ID NO: 116764 - DNA, 878 bp, Homo sapiens
  Payload ID: 2771
  Gene Symbol: CRBN
  Gene Name: cereblon
  ENST ID: ENST00000450014
  CDS Start-End: 1-686
gagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaaggtgagaaactaattttttatgcatcttcaaaaaatgaagacaggttgttttttttcctgttttaagaaagaaacacaactttcatgattcattacccagccaccttgtatggcaatattccagctacatttgatcctctaaaaattgcacaggcagctactttatgtaaaagcagtttacaaaagcaataaaatgtcacacagc

SEQ ID NO: 116765 - DNA, 2038 bp, Homo sapiens
  Payload ID: 2771
  Gene Symbol: CRBN
  Gene Name: cereblon
  ENST ID: ENST00000424814
  CDS Start-End: 1-1184
gagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcaggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcctgtgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccagactaaacttgatactgtattattttgttcaatgtaaattgaagaaaatctgtaagtaagtaaaccttaagtgtgaaactaaa

SEQ ID NO: 116766 - DNA, 2203 bp, Homo sapiens
  Payload ID: 2771
  Gene Symbol: CRBN
  Gene Name: cereblon
  Uniprot ID: Q96SW2
  ENST ID: ENST00000432408
  CDS Start-End: 24-1349
gcctcctttgcgggtaaacagacatggccggcgaaggagatcagcaggacgctgcgcacaacatgggcaaccacctgccgctcctgcctgagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcctgtgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccagactaaacttgatactgtattattttgttcaatgtaaattgaagaaaatctgtaagtaagtaaaccttaagtgtgaaactaaa

SEQ ID NO: 116767 - DNA, 1894 bp, Homo sapiens
  Payload ID: 2772
  Gene Symbol: CCM2
  Gene Name: cerebral cavernous malformation 2
  Uniprot ID: Q9BSQ5
  ENST ID: ENST00000258781
  CDS Start-End: 150-1484
ggggcgcggccggggcggagacttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaa

SEQ ID NO: 116768 - DNA, 1881 bp, Homo sapiens
  Payload ID: 2772
  Gene Symbol: CCM2
  Gene Name: cerebral cavernous malformation 2
  Uniprot ID: Q9BSQ5
  ENST ID: ENST00000381112
  CDS Start-End: 72-1469
agtcatgtttttttcagagggagggctaacatctggccatatttttcaacaaattcagaagtgagtagagaatgcatagtagctgtcggcagaggaggaaccagaatctctccaaagaaattcctcaaacagaatttcacacagggtattccatggagaatgagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagc

SEQ ID NO: 116769 - DNA, 2471 bp, Homo sapiens
  Payload ID: 2772
  Gene Symbol: CCM2
  Gene Name: cerebral cavernous malformation 2
  ENST ID: ENST00000475551
  CDS Start-End: 761-2077
gaagaagtgagcttggccagaggcacgctgtttaatttcaaagtgctgctgactcaaactcatgagtcctggaggcaggtagaggcacttgtaggctgaggacccgtagagcccggtgtgccctgcccaagccccacctgggaatggagttatctctgtaaagatcttgctgcctttgagcaagcactgcaaatggggtaactggaacagccttgtcgcgtgtttccacccttcgtatgaggcaggtaccatgggtcttcaccaacagcacggcctgttgtctccaggaaatggtagcccctcacagtgctttctgtctgcttgtttagctttggcatttgaatgtgcagaatggtggactttgaaattaatgtccttctgttgactgcagaatttctgctggaaatgcagggaggctgcttgtggggttcgcgtgctgtgggaagtagggaaaatgagctggtttactttgtgtctttttgtgcatgcagactgtttggattttgccaacagtttctgggtgctgcctgctttttaaacttttaaaaaattgtaaacagcttcagtggctttgcagaaggaagctgtggtttctggtcttcctgttcagtcatgtttttttcagagggagggctaacatctggccatatttttcaacaaattcagaagtgagtagagaatgcatagtagctgtcggcagaggaggaaccagaatctctccaaagaaattcctcaaacagaatttcacacagggtattccatggagaatgagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataattt

SEQ ID NO: 116770 - DNA, 1719 bp, Homo sapiens
  Payload ID: 2772
  Gene Symbol: CCM2
  Gene Name: cerebral cavernous malformation 2
  ENST ID: ENST00000488727
  CDS Start-End: 86-901
cgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcaga

SEQ ID NO: 116771 - DNA, 406 bp, Homo sapiens
  Payload ID: 2772
  Gene Symbol: CCM2
  Gene Name: cerebral cavernous malformation 2
  ENST ID: ENST00000480382
  CDS Start-End: 1-406
gaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgccagccacgtgacctcttccacagtcacatcttcctttgactgtcagcttcctctgcatttcaggactcttgcaatcacattgagcccacccaaattctccagggtcatctccctatttcaagatgactcttctacaaaagtggacattaaggagacctacgaggtggaagccagcactttgtg

SEQ ID NO: 116772 - DNA, 1532 bp, Homo sapiens
  Payload ID: 2772
  Gene Symbol: CCM2
  Gene Name: cerebral cavernous malformation 2
  ENST ID: ENST00000474617
  CDS Start-End: 115-1158
atatttttcaacaaattcagaagtgagtagagaatgcatagtagctgtcggcagaggaggaaccagaatctctccaaagaaattcctcaaacagaatttcacacagggtattccatggagaatgagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtt

SEQ ID NO: 116773 - DNA, 1620 bp, Homo sapiens
  Payload ID: 2772
  Gene Symbol: CCM2
  Gene Name: cerebral cavernous malformation 2
  Uniprot ID: Q9BSQ5
  ENST ID: ENST00000544363
  CDS Start-End: 147-1208
gcgcggccggggcggagacttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagc

SEQ ID NO: 116774 - DNA, 1719 bp, Homo sapiens
  Payload ID: 2772
  Gene Symbol: CCM2
  Gene Name: cerebral cavernous malformation 2
  Uniprot ID: Q9BSQ5
  ENST ID: ENST00000541586
  CDS Start-End: 147-1307
gcgcggccggggcggagacttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagc

SEQ ID NO: 116775 - DNA, 2523 bp, Homo sapiens
  Payload ID: 2773
  Gene Symbol: CCM2L
  Gene Name: cerebral cavernous malformation 2-like
  Uniprot ID: Q9NUG4
  ENST ID: ENST00000262659
  CDS Start-End: 6-1307
tcaccatggaatatgaagtcaagaaagggaagaagggctttgtatcccccatccgaaggctggtgttccccaaggccgggcgccgggcagcctgtaggagcagcgtgagccgccggcccctgcactcgatgcccctttatccccccgactacctcatcgacccccagattctgctgtgtgactacctggagaaagaggtcaagttcctgggccaccttacctgggtgacttcctcactgaacccctccagtcgggacgagctcctgcagctgctagacaccgccaggcagctgaaggagctgccgctgaagaccacggcggagcaggacagcatcctgagcctgtctgcccgctgcctgctgctcacctggcgcgacaatgaagagctcattctgcgaatccctacgcacgagatcgccgccgcctcctacctgcaggacgacgcgctgcacctgctagtgctcaagaccggtctgggtgtggacccggtgccggccggcgtggatgccagcccaggcggcgcaggacgcgaccccggcccgccaggcggggcgcccgagaagcggcgggtgggcaccgcggagcggcgccacaccatctgcagcctggactggcggatggggtggggtgggggcgccgcggaggcccgggccgggggaggcggcggcggcagcttggagcgccagcgcgccggggcgcgggcgtcgggcagctgggagcgacggcagacgttcagcggcagctgggagcggcggcacggaggcggcggcggcggcggcggcgcgggaaagccgggcggtagctgggagcggaggcaggcgggcagcggcgggggaggcagctgggagcggcgccaccccggccccaacccgctcgacccgcaggaccccagccccgacgcctactgcaacctggtcatcctggctgtagccaacagggacgctgcagaggagtcctgcgcactcatctgtcaggtcttccagatcatctacggggaccagagtattgagtgtgtggaccgggctggctaccactacacatccacacctgaacggccatggctctgcagccgcataatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggcatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggctccaggggcgggagcgacgccgcagaagacaactacctgtagccaccgcccctgcggacggcgtggctcagcagcccacctctgagtctcagctttgcttcggggaccctatccccagggcccccccatcacacctggcggggccggggggtcttcactccagggtctcgctccctgcccttggggcccggggccatgcagtacctggagtgtcctgcagggggaaagcgaagccgggccctgaagtccggggcagtcacccggggctcctgggccgctctgccgggctggggctgagcagcgatcctgctttgtcccagaagtccagagggatcagccccagaacacaccctcctccccgggacgccgcagctttctggaggctgaggaaggcatgaagagtgggctccacctgctggccgactgagaaaagaatttccagaactcggtcctattttacagattgagaaactatggttcaagaagagaggacggggcttgagggaatctcctgattctccttatatgacctcaaactgaccatactaaacagtgtagaaggtctttttaaggctctaaatgtcagggtctcccatcccctgatgcctgacttgtacagtcagtgtggagtagacggtttcctccacccagggttgactcagggggatgatctgggtcccattctggtcttaagaccccaaacaagggttttttcagctccaggatctggagcctctatctggttagtgtcgtaacctctgtgtgcctcccgttaccccatctgtccagtgagctcagcccccatccacctaacagggtggccacagggattactgagggttaagaccttagaactgggtctagcacccgataagagctcaataaatgttgttcctttccacatcaaa

SEQ ID NO: 116776 - DNA, 1841 bp, Homo sapiens
  Payload ID: 2773
  Gene Symbol: CCM2L
  Gene Name: cerebral cavernous malformation 2-like
  ENST ID: ENST00000452892
  CDS Start-End: 1-975
gagcggcggcacggaggcggcggcggcggcggcggcgcgggaaagccgggcggtagctgggagcggaggcaggcgggcagcggcgggggaggcagctgggagcggcgccaccccggccccaacccgctcgacccgcaggaccccagccccgacgcctactgcaacctggtcatcctggctgtagccaacagggacgctgcagaggagtcctgcgcactcatctgtcaggtcttccagatcatctacggggaccagagtattgagtgtgtggaccgggctggctaccactacacatccacacctgaacggccatggctctgcagccgcagtgagagctgccacacagatgggacgtatgcctatgatgccgacttcagctgctgcagctcctttaatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggcatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggctccaggggcgggagcgacgccgcagaagacaactacctgtagccaccgcccctgcggacggcgtggctcagcagcccacctctgagtctcagctttgcttcggggaccctatccccagggcccccccatcacacctggcggggccggggggtcttcactccagggtctcgctccctgcccttggggcccggggccatgcagtacctggagtgtcctgcagggggaaagcgaagccgggccctgaagtccggggcagtcacccggggctcctgggccgctctgccgggctggggctgagcagcgatcctgctttgtcccagaagtccagagggatcagccccagaacacaccctcctccccgggacgccgcagctttctggaggctgaggaaggcatgaagagtgggctccacctgctggccgactgagaaaagaatttccagaactcggtcctattttacagattgagaaactatggttcaagaagagaggacggggcttgagggaatctcctgattctccttatatgacctcaaactgaccatactaaacagtgtagaaggtctttttaaggctctaaatgtcagggtctcccatcccctgatgcctgacttgtacagtcagtgtggagtagacggtttcctccacccagggttgactcagggggatgatctgggtcccattctggtcttaagaccccaaacaagggttttttcagctccaggatctggagcctctatctggttagtgtcgtaacctctgtgtgcctcccgttaccccatctgtccagtgagctcagcccccatccacctaacagggtggccacagggattactgagggttaagaccttagaactgggtctagcacccgataagagctcaataaatgttgttcctttccacatcaaa

SEQ ID NO: 116777 - DNA, 1492 bp, Homo sapiens
  Payload ID: 2774
  Gene Symbol: CDNF
  Gene Name: cerebral dopamine neurotrophic factor
  Uniprot ID: Q49AH0
  ENST ID: ENST00000378442
  CDS Start-End: 505-762
gccactccacgacatccctaggccggcgacacgccgctctcaagcctgtggatgacccagcgccagaaaaccgggtggccgtcatgaagccctagcccagctccgcagcccctcaccttatagacggccacacaggctgaggtgcagcccaggtaaagaagcttgtgtaatcgcagaggaaggacataacagtttgagcctcactctgtcacccaggttggagtacagtggaacagtctcagctcactgcaacttccgtcttccaggctcaagtgatcctccctcctcagcctcctgagtagctggactacagtatgtaaagaattcttgaaccgattctacaagtcactgatagacagaggagttaacttttcgctggacactatagagaaagaattgatcagtttttgcttggacaccaaaggaaaagaaaaccgcctgtgctattatctaggagccacaaaagacgcagccacaaagatcctaagtgaagtcactcgcccaatgagtgtgcatatgcctgcaatgaagatttgtgagaagctgaagaagttggatagccagatctgtgagctgaaatatgaaaaaacactggacttggcatcagttgacctgcggaagatgagagtggcagagctgaagcagatcctgcatagctggggggaggagtgcagggcctgtgcagaaaaaactgactatgtgaatctcattcaagagctggcccccaagtatgcagcgacacaccccaaaacagagctctgatctccaatgccagcacatttgtgacttgtaattagagagaaaagtgactctctaggatatggacatgttgattaaggataactgggaatgcatcatatttggtctcatgctttttgtgttggtattattcctcagaattttgttacgtgggtttatgagtgaaactaatactactgataacttacatttgcagtgtaccaaaagctaaaagttcctttctcataagtttcttggaatgactatgccagttttcattgcctgtctcctaaaagtgacctactgacaaattgatggagtaaattgattccaagaaagaagaaggcattcagagactcctctctggatgcaattttaaaatatattggactaaaacaaaagacacaacagtcagcttatctaatgcacaacttcaatcccaaatacagaatcaaaagtttttttcaagtgaattttctgttttcactctatattgtagctctctttggtatcagaaatggtcaggcaggagtactcgtttttcccattggaagaaaacccacttaaacctacttaaagaaaatagagagatcaagaaaccgtataagtatagccaatgtttggcaattatatcaacatttacattgttaattgaaccaagctcaaggtctttttcattccttacagtcacatatcagacaagtttttgatggaagattaaagcatattaaaaacactcataggcaacttggaa

SEQ ID NO: 116778 - DNA, 690 bp, Homo sapiens
  Payload ID: 2774
  Gene Symbol: CDNF
  Gene Name: cerebral dopamine neurotrophic factor
  Uniprot ID: Q49AH0
  ENST ID: ENST00000465530
  CDS Start-End: 127-690
gttgcgtcatttgtcctggcaactactggcagattctttccaacctcgaattctgctcagctcgctttggcagcttggtgggcggtgggcgcgggtggcggaggcgattgaagctgctggcccagcatgtggtgcgcgagcccagttgctgtggtggccttttgcgccgggcttttggtctctcacccggtgctgacgcagggccaggaggccggggggcggccaggggccgactgtgaagtatgtaaagaattcttgaaccgattctacaagtcactgatagacagaggagttaacttttcgctggacactatagagaaagaattgatcagtttttgcttggacaccaaaggaaaagaaaaccgcctgtgctattatctaggagccacaaaagacgcagccacaaagatcctaagtgaagtcactcgcccaatgagtgtgcatatgcctgcaatgaagatttgtgagaagctgaagaagttggatagccagatctgtgagctgaaatatgaaaaaacactggacttggcatcagttgacctgcggaagatgagagtggcagagctgaagcagatcctgcatagctggggggaggagtgcagggcctgtgcagaaaaaactgactatgtgaatctcattcaagagctggcccccaagtatgcagcgacacaccccaaaacagagctctga

SEQ ID NO: 116779 - DNA, 2685 bp, Homo sapiens
  Payload ID: 2775
  Gene Symbol: CERCAM
  Gene Name: cerebral endothelial cell adhesion molecule
  Uniprot ID: Q5T4B2
  ENST ID: ENST00000372838
  CDS Start-End: 399-2186
ccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgattcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaa

SEQ ID NO: 116780 - DNA, 5201 bp, Homo sapiens
  Payload ID: 2775
  Gene Symbol: CERCAM
  Gene Name: cerebral endothelial cell adhesion molecule
  Uniprot ID: Q5T4B2
  ENST ID: ENST00000372842
  CDS Start-End: 3145-4698
gggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctgggccgctggcctagaaatggcctcaaatggaagctgccacccgatcctggtggaggctttgagctaggctagagatcaggactccagggttcagtgcgcacgtgctgcccctgcactagggccgaagcaatgcgggtgctggcgaccgacgcaaggaggtgacgcacaggggacttaaggagcggaccgccgcgggaggacgcgcccagctcagggggactccctctgcgccccccacgctgggtctccggcccacgcgtggcccggctggtctgcggagctagcgccagggccgccagagggcgcccggggcggaggatggggcgggagccggggaagcccgggaggtggtggccgagtgggcgccgcccctctgggtctgcggctcaggtcgaagagtcggctgcgtgggccggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctggtgagagacccgggcattggcaccgagtgggcacctaacccccagcttcgcagatggcccccgcccccggcggccctgtctgctcgctccctgcccagacaccacctagacaggcccctcccctcacagacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggttgggggtgccatcagcactgggctccgggctgtgcaggggagtcagaccggcccccccaccgcccccgtgctggggccagctctcttggtagatcttggtagaggggcgggatcctgtcagccaagggcagtcccccttcctggagcctctcccctctggcatctctgtacccccagggcactgggatcgaaggccacaacccctggtctgtagacaccagaacagggaggagtccctggctgaggttgggggtaaactgagaaaaatgacaagccaccctcttcaacacaccacagttgggctgggggggtggagccctggcctggggaggccgcccacaattaccacagtttgggagtttgttagttcccacccctgtaagacttgacacgtagtcttcatttctggggaattggcttaaaggggcagcatcacccaaaacctgggcacttggctaaacccccacctctgttatgggggccccttccccaggagaggggaggctgtgccccatgacagcagagcttggacccatctgcattcttagggacgcttagagcatggtttggtccttattacaacctgggggtggaggaaagcagcagctcttctgtctagtccccattcagagagggacaggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgttagtgctttggggtcaaggctgccttggggttcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgattcagggccttgtggcccccagcttctgtttcaagctgggcagaccccaggatcccttccctccctaaggactcagctgaggggcccctctgcccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcactttaaatata

SEQ ID NO: 116781 - DNA, 551 bp, Homo sapiens
  Payload ID: 2775
  Gene Symbol: CERCAM
  Gene Name: cerebral endothelial cell adhesion molecule
  ENST ID: ENST00000420034
  CDS Start-End: 360-551
aagtctaagcagaatgggcagagatgcctccagctgggctttgagggtgtcagtcttccctcaaataggaaagatgaggggcaggggaggatattggggacaagcctctgctcagccctgggtcctcttggaaccgggcttggagccggaggtggggagggtgtccaagctgagctcctggattcccatctgccgaactgcacccagaaccaggagtggggtgcgggcccatcctctggccaggatcctgggctcccttggccacaaagcaggacaggggaccagagatcccccaactcaggagacgtgaagctggcagctggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctg

SEQ ID NO: 116782 - DNA, 530 bp, Homo sapiens
  Payload ID: 2775
  Gene Symbol: CERCAM
  Gene Name: cerebral endothelial cell adhesion molecule
  ENST ID: ENST00000447915
  CDS Start-End: 203-530
aagggagaagaaatctggcatctctccagaatgcttctcattgcagggccgctggcctagaaatggcctcaaatggaagctgccacccgatcctggtggaggctttgagctaggctagagatcaggactccagggttcagtgcgcacgtgctgcccctgcactaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagg

SEQ ID NO: 116783 - DNA, 1176 bp, Homo sapiens
  Payload ID: 2775
  Gene Symbol: CERCAM
  Gene Name: cerebral endothelial cell adhesion molecule
  ENST ID: ENST00000411852
  CDS Start-End: 940-1176
cggggaatccggattccgggggttcaacgcccaggggttccatgagcccctactgttctcggacgcccggccggccccgacgcactcgtcctagcacccctcccctgtccggtcctccggcccctccgccgtcgcccctccggggtccagccgggcggggctgctccagggtcgcggctggcgcgggtccccgggccctggccctccggtgccccgggccaaggagagaaaacttgagcatccacgcacaggggtggggagcaggatcccactctgagggtgcactgccccgccctctccgggtctgcctcggccccgcccgggccccaggccccgccccctcccctcggccggcccgagagctccgggggccgctgcagccgcccaagcgcccgccatgcgcgctgcccgcgccgcgccgctgctccagctgctgctcctgctggggccgtggctggaggctgcgggcgttgcggagtcgccgctgcccgccgtggtccttgccatcctggcccgcaatgccgaacactcgctgccccactacctgggcgctctggagcggctggactacccccgggccaggatggccctctgacggccctgccagcccgagccgccagagaggaccccgagccccctgctgggagacgacagacctctgaggccacaggccgacgcgggacacccacccctccttctggtcccctactccttcctcttggggccttccctgggtgtaggttgggcccagccagcccttttcaccccagccttcagggcccagctcaaccccagtgggacctgtggttggctggatttgaagaggagcagacaggaacctctgaagtccactggggcccaacgtggcagggatcgaccacgctggaggcttccgggcacaggtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcgg

SEQ ID NO: 116784 - DNA, 887 bp, Homo sapiens
  Payload ID: 2775
  Gene Symbol: CERCAM
  Gene Name: cerebral endothelial cell adhesion molecule
  ENST ID: ENST00000420512
  CDS Start-End: 234-887
ggaaagggacctgtctgaggttggtgacagacacccagttcgatcccatctgtggtgccgccaggccgctcccttttctgctcctctcccgagaggctgcagagttctttccctcccagcagggtcctaaggaccccggcggtgctccaggggagccaacatcccctgctttggaggacggacgggtcgggtcgcagtgtgccacggaccacaatgtggacaacaccacagagatgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactaggt

SEQ ID NO: 116785 - DNA, 1429 bp, Homo sapiens
  Payload ID: 2775
  Gene Symbol: CERCAM
  Gene Name: cerebral endothelial cell adhesion molecule
  ENST ID: ENST00000613052
  CDS Start-End: 946-1413
gtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatggctggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctaggtccaggtgatgactgcaaagcagtgtccaggagcaggccactactgcccagagagcagaggaggaggttgttggcagggactgcagatcctgtcagacctggccaccaccttgggcatggccactctgccctctggacctgtctttcatcgggagaaaccactcagagatggatcccattccctaaaggtctcacagcaaaggagcaggactcccaggcccctgtaccctgcctggcctgattcagggccttgtggcccccagcttgtttcaagctgggcagaccccaggatcccttccctccctaaggactcagctgaggggcccctctgccccttctacctccacctcagcaccctcccccagcttgatgtttgggtctccccagcaccctcctccctggccggtgcaaagtacagggaggtaaagcaggacccttgcagacatgttgcccagcacacagtaggccctcaataaaagccatttgcacttt

SEQ ID NO: 116786 - DNA, 1554 bp, Homo sapiens
  Payload ID: 2775
  Gene Symbol: CERCAM
  Gene Name: cerebral endothelial cell adhesion molecule
  ENST ID: ENST00000612334
  CDS Start-End: 1-1554
atgctgcaggagtggctggcggctgtgggcgatgactatgctgctgtggtctggaggcctgagggcgagcccaggttctacccagatgaagagggtcccaagcactggaccaaagaaaggcaccagtttctgatggagctgaagcaggaagccctcacctttgccaggaactggggggccgactatatcctgtttgcagacacagacaacattctgaccaacaatcagactctgcggcttctcatggggcaggggcttccagtggtggccccaatgctggactcccagacctactactccaacttctggtgtgggatcaccccccagggctactaccgccgcacagccgagtacttccccaccaagaaccgccagcgccggggctgcttccgtgtccccatggtccactccaccttccttgcatccctgcgggctgaaggggcagaccagcttgctttctacccgccacatcccaactacacttggcctttcgacgacatcatcgtcttcgcctatgcctgccaggctgctggggtctccgtccacgtgtgcaatgagcaccgttatgggtacatgaatgtgccggtgaaatcccaccaggggctggaagacgagagggtcaacttcatccacctgatcttagaagcactagtggacggcccccgcatgcaggcctcagctcatgtgactcggccctctaagaggcccagcaagatagggtttgacgaggtctttgtcatcagcctggctcgcaggcctgaccgtcgggaacgcatgctcgcctcgctctgggagatggagatctctgggagggtggtggacgctgtggatgctgggatgctcaacagcagtgccatcaggaacctcggcgtagacctgctcccgggctaccaggacccttactcgggccgcactctgaccaagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctag

SEQ ID NO: 116787 - DNA, 1580 bp, Homo sapiens
  Payload ID: 2776
  Gene Symbol: CLN3
  Gene Name: ceroid-lipofuscinosis, neuronal 3
  Uniprot ID: Q13286
  ENST ID: ENST00000333496
  CDS Start-End: 100-1344
agaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgg

SEQ ID NO: 116788 - DNA, 1660 bp, Homo sapiens
  Payload ID: 2776
  Gene Symbol: CLN3
  Gene Name: ceroid-lipofuscinosis, neuronal 3
  ENST ID: ENST00000355477
  CDS Start-End: 324-869
gtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 116789 - DNA, 1469 bp, Homo sapiens
  Payload ID: 2776
  Gene Symbol: CLN3
  Gene Name: ceroid-lipofuscinosis, neuronal 3
  Uniprot ID: Q13286
  ENST ID: ENST00000357806
  CDS Start-End: 225-1244
gggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgat

SEQ ID NO: 116790 - DNA, 1519 bp, Homo sapiens
  Payload ID: 2776
  Gene Symbol: CLN3
  Gene Name: ceroid-lipofuscinosis, neuronal 3
  ENST ID: ENST00000357857
  CDS Start-End: 178-1332
ccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggag

SEQ ID NO: 116791 - DNA, 1733 bp, Homo sapiens
  Payload ID: 2776
  Gene Symbol: CLN3
  Gene Name: ceroid-lipofuscinosis, neuronal 3
  ENST ID: ENST00000359984
  CDS Start-End: 486-1496
gtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 116792 - DNA, 1913 bp, Homo sapiens
  Payload ID: 2776
  Gene Symbol: CLN3
  Gene Name: ceroid-lipofuscinosis, neuronal 3
  Uniprot ID: Q13286
  ENST ID: ENST00000360019
  CDS Start-End: 360-1676
ataactggtgctggcaggctactgtctcggtcttgggcgccactgatctaaggtcacggctctgcttgctgctcccacccgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 116793 - DNA, 1577 bp, Homo sapiens
  Payload ID: 2776
  Gene Symbol: CLN3
  Gene Name: ceroid-lipofuscinosis, neuronal 3
  ENST ID: ENST00000395653
  CDS Start-End: 406-1422
aaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgca

SEQ ID NO: 116794 - DNA, 2374 bp, Homo sapiens
  Payload ID: 2776
  Gene Symbol: CLN3
  Gene Name: ceroid-lipofuscinosis, neuronal 3
  Uniprot ID: Q13286
  ENST ID: ENST00000569430
  CDS Start-End: 821-2137
gctcatgggactcctgcctctcctgggcttggccgctcctgtcttggcaagccccagaccctgccttggatttctttctggcctccaagtgggcgcttggctcctggcacctggcagccttggctgtctccccagccccactgtcctgcctctctgcttgggacccatgggagctgccatctccccagccccagtgctgggatgacaggcatgagccaccacacccagacgagagggcacatttccaactgcattctgaaggcctggtggtgagaaagagcatatagaggtggcacagcccatagcagagatgaggccaaggacaagaagagaatgcaggatgccgctttccacctagaagaagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 116795 - DNA, 539 bp, Homo sapiens
  Payload ID: 2776
  Gene Symbol: CLN3
  Gene Name: ceroid-lipofuscinosis, neuronal 3
  ENST ID: ENST00000564091
  CDS Start-End: 1-406
actcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggggggccagccattgtctcccacttggggagtttcttcctggcatcatgccttctgaataaatgccgattttatccatgga

SEQ ID NO: 116796 - DNA, 1109 bp, Homo sapiens
  Payload ID: 2776
  Gene Symbol: CLN3
  Gene Name: ceroid-lipofuscinosis, neuronal 3
  Uniprot ID: Q13286
  ENST ID: ENST00000569030
  CDS Start-End: 1-762
atgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagatggagtctcgctctgttgcccaggctggaatgtagcggtgcaatcttggctcactgcaacccctgcctcccagattcaagcgattctcaagcctcagccttccgagtagctgggattacagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctga

SEQ ID NO: 116797 - DNA, 886 bp, Homo sapiens
  Payload ID: 2776
  Gene Symbol: CLN3
  Gene Name: ceroid-lipofuscinosis, neuronal 3
  ENST ID: ENST00000568443
  CDS Start-End: 360-886
ataactggtgctggcaggctactgtctcggtcttgggcgccactgatctaaggtcacggctctgcttgctgctcccacccgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggtgagtattcccgcccaccctcatggaacgaccacctctggctcgcagcccacctgaggggaatgagagctgactcggccccgggaggacacgcaaggagcggtcgtgcacctgagagtaggtgggggtcatgccctcttctcgctctcccaggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacag

SEQ ID NO: 116798 - DNA, 1225 bp, Homo sapiens
  Payload ID: 2776
  Gene Symbol: CLN3
  Gene Name: ceroid-lipofuscinosis, neuronal 3
  ENST ID: ENST00000565140
  CDS Start-End: 1-546
atgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagagacagagttttgctcttgtagctcaggctagagtacaatggcgtgatcttggctcactgcaacctccgcctcccaggttcaggcgattcttctgcctcagcctcctgcgtagctgggattacagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctga

SEQ ID NO: 116799 - DNA, 557 bp, Homo sapiens
  Payload ID: 2776
  Gene Symbol: CLN3
  Gene Name: ceroid-lipofuscinosis, neuronal 3
  ENST ID: ENST00000567804
  CDS Start-End: 336-557
atcatagctcactgtagcttcaacctcctgggcacaagtgatcctcccacctcagcttccaagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccat

SEQ ID NO: 116800 - DNA, 1325 bp, Homo sapiens
  Payload ID: 2776
  Gene Symbol: CLN3
  Gene Name: ceroid-lipofuscinosis, neuronal 3
  ENST ID: ENST00000567963
  CDS Start-End: 113-1138
ctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggacttaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggag

SEQ ID NO: 116801 - DNA, 1224 bp, Homo sapiens
  Payload ID: 2776
  Gene Symbol: CLN3
  Gene Name: ceroid-lipofuscinosis, neuronal 3
  ENST ID: ENST00000568422
  CDS Start-End: 239-637
gatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattca

SEQ ID NO: 116802 - DNA, 735 bp, Homo sapiens
  Payload ID: 2776
  Gene Symbol: CLN3
  Gene Name: ceroid-lipofuscinosis, neuronal 3
  ENST ID: ENST00000568558
  CDS Start-End: 184-735
gttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctc

SEQ ID NO: 116803 - DNA, 762 bp, Homo sapiens
  Payload ID: 2776
  Gene Symbol: CLN3
  Gene Name: ceroid-lipofuscinosis, neuronal 3
  ENST ID: ENST00000567495
  CDS Start-End: 74-619
ctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactt

SEQ ID NO: 116804 - DNA, 1266 bp, Homo sapiens
  Payload ID: 2776
  Gene Symbol: CLN3
  Gene Name: ceroid-lipofuscinosis, neuronal 3
  Uniprot ID: Q13286
  ENST ID: ENST00000565316
  CDS Start-End: 1-1266
atgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaaggttcggatgatggctgggtttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctga

SEQ ID NO: 116805 - DNA, 650 bp, Homo sapiens
  Payload ID: 2776
  Gene Symbol: CLN3
  Gene Name: ceroid-lipofuscinosis, neuronal 3
  ENST ID: ENST00000565688
  CDS Start-End: 121-650
caaacggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctgcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccgga

SEQ ID NO: 116806 - DNA, 577 bp, Homo sapiens
  Payload ID: 2776
  Gene Symbol: CLN3
  Gene Name: ceroid-lipofuscinosis, neuronal 3
  ENST ID: ENST00000568497
  CDS Start-End: 100-348
ttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacact

SEQ ID NO: 116807 - DNA, 931 bp, Homo sapiens
  Payload ID: 2776
  Gene Symbol: CLN3
  Gene Name: ceroid-lipofuscinosis, neuronal 3
  ENST ID: ENST00000566057
  CDS Start-End: 1-318
atgggaggctgtgcaggctcgcggcggcgcttttcggattccgagggggaggagaccgtcccggagccccggctccctctgttggaccatcagggcgcgcattggaagaacgcggtgggcttctggctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctga

SEQ ID NO: 116808 - DNA, 609 bp, Homo sapiens
  Payload ID: 2776
  Gene Symbol: CLN3
  Gene Name: ceroid-lipofuscinosis, neuronal 3
  ENST ID: ENST00000561505
  CDS Start-End: 248-609
atagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgc

SEQ ID NO: 116809 - DNA, 569 bp, Homo sapiens
  Payload ID: 2776
  Gene Symbol: CLN3
  Gene Name: ceroid-lipofuscinosis, neuronal 3
  ENST ID: ENST00000565778
  CDS Start-End: 69-569
ccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgta

SEQ ID NO: 116810 - DNA, 1422 bp, Homo sapiens
  Payload ID: 2776
  Gene Symbol: CLN3
  Gene Name: ceroid-lipofuscinosis, neuronal 3
  ENST ID: ENST00000628023
  CDS Start-End: 324-572
gtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 116811 - DNA, 1586 bp, Homo sapiens
  Payload ID: 2776
  Gene Symbol: CLN3
  Gene Name: ceroid-lipofuscinosis, neuronal 3
  ENST ID: ENST00000631023
  CDS Start-End: 324-1349
gtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggacttaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 116812 - DNA, 4064 bp, Homo sapiens
  Payload ID: 2777
  Gene Symbol: CLN5
  Gene Name: ceroid-lipofuscinosis, neuronal 5
  ENST ID: ENST00000377453
  CDS Start-End: 1293-2516
tttttttttttttttaaagctgttcctgctgattgctttttaagctaggctcaagtgtggggccacggaatccttcaggtgcccttcaaatcagacattacatttcagctctcagggctagaatgcttccccctcttatcttgggcaggtctttgaagaagccagtttagccttggtaattttgaatttggccatagtatacggaggagagctaggtagctatcaaaacgcttagacaaacgtatggtaaaatgcagcccagcctgaacctccgcaaaacccccaaacctggagcagcaagtgggcaaaggagtgtgtgtttggggcagggtactgagtcccatatgtaatcaagagacctggagggcccaaggaagtcagtgacacccccacaagctacatatcctccaatggattgtggtggtcatctccggctaccgaagccaccttgcttattcccataggcttacaaacattatgatgcttcacacgagttgtgggtgaagtgaaggaattggaaagtcccggtctaaggccctgcaaaactgctgtctggtaaaaacaagtgactatggcaaggccctgaatgtactacgtatagacttaagtcagtatttgtgcctaacagcaaagcatgccacaagaggctcctcaaaagccgggtaattgatgccattgttttcttgacctagttgaagagtcaaagaagagaaggtgatgcagaaacttctttccagtgaagtgacagatccaagcaaggaacacctgcctgtgaggggagcggtaggggagggggtagattcggcagcactcgggtagtggcagggaccacatattgtcggtgttaaccactgttatcactggcccaggtcgagtgaggacgagtcatttccccactaagcacttggggagtggcagggaccacatattgtcagtgttaaccactgttatgactggcccaggtcgggtgacgacgagccatttccgcactattgtcccttcttcctcactgcacccccagccctgcaccctcagctccaaatacacattctcgttcactcaacgtttgttgacacctagcgtgggccctgtgggatggggtaaaagttcggtgttgggaggagccccggtgacagatttttggttttggtggtggcttttgggcaaggacaggtcaattcataaaagatgacgccccaggtctggatcgaattctcctgggagccagaccaaagcaccttcctggactgcaaagtgtggaagccgccgcgggccgggcgcggggaggtgtcatgcgccggaacctgcgcttggggccaagctctggagctgacgcgcaggggcaaggcgccccgcgtcccggactggcggctccgcgcatgctcctcccaccggcgtcgcaggcctcgagaggctccggaagtactgggtgcagcctgatggcgcaggaggtagacacggcacagggcgccgagatgcggcggggcgcgggcgcggctcggggacgcgcttcctggtgctgggccctggcgctgctttggctcgcggtggttccgggctggtcccgggtctcgggcatcccctcccggcgccactggccggtgccctacaagcgctttgacttccgtccaaaacctgatccttattgtcaagctaagtatactttctgtccaactggctcacctatcccagttatggagggtgatgatgacattgaagtttttcgattacaagccccagtatgggaatttaaatatggagacctcctgggacacttgaaaattatgcatgatgccattggattcagaagtacattaactggcaagaactacacaatggaatggtatgaacttttccaacttggcaactgtacatttccccatctccgacctgaaatggatgcccctttctggtgtaatcaaggcgctgcctgcttttttgagggaattgatgatgttcactggaaggaaaatgggacattagttcaagtagcaactatatcaggaaacatgttcaaccaaatggcaaagtgggtgaaacaggacaatgaaacaggaatttattatgagacatggaatgtaaaagccagcccagaaaagggggcagagacatggtttgattcctacgactgttccaaatttgtgttaaggacctttaacaagttggctgaatttggagcagagttcaagaacatagaaaccaactatacaagaatatttctttacagtggagaacctacttatctgggaaatgaaacatctgtttttgggccaacaggaaacaagactcttggtttagccataaaaagattttattaccccttcaaaccacatttgccaactaaagaatttctgttgagtctcttgcaaatttttgatgcagtgattgtgcacaaacagttctatttgttttataattttgaatattggtttttacctatgaaattcccttttattaaaataacatatgaagaaatccctttacctatcagaaacaaaacactctctggtttataaaacaccttaattctactgctcttttttctccaatcaccagcatctgtttttcagggggtgattttacttttgtgaattccttagcctttcttccttggtgcataaagttaaaatgcacatcagcagaattgctgcatattaacatctcaggactcttctcttgtaaagaagctgaaattcgtactatattggccaaagtgagcgagttaggtgatcttggtttcaatttccgagcctttgttaatatggagaattatggttcatatcagttatgtaggacctttggacccagggtcctacagatagatatggtgtgcccagattttaaaaataccttcaaaaataaaaaatacattcagtgacattttcatggtgggagctcttctttctgatatggcagttacactttttcacttaagtgctttagtttagactaactttacaacttctataacttttggaaccaagtttagtatagtctgattacattccattcacctaactttagacattcgtttagacaccataactggagtgattgtgcttctagatgtggcaaatccagtgttaacacatatttctggctgagattttggaactagctagtaactggcttgtgttctttaagcatactaacatcactaaatcttaggatttaggattgctgtaaagatgtaagttgtgtatgtttggcaggtcacattgaatggcagtgataatgattaatcaaagaacaaatgtcatccttgatcttgcctaatgtagtttatgtgccaaactttccagggttttgtagtcacctagattttaagctgatagcatagtgcttcagcggttcttctaaccggggtatgcaggaacatggctgcagacacgtttgggtaaacaggcaccttctgacttcttcattgtttcctgtagttctccctcttcccacaaagctgtcagcgcagtggaagaggttgcacttctccgagagaggacaggtttctgttaagatcaccaagtagctgtgctttaattagagccagacaagctttcaaggtcctttaagtatttgatgatcaactgaacacgtttctattcaaggagaaaacaccattcagtaagaagatggagtagatatcagataaaacaattcacgtttaatatgtaaatgtaccaattatgtgattcagtttcaactttcaagtacttcctgagaggttagtacattattattgagctctcacagaaagcttaatcatagatataattaacctgatccaaatgagtaaagtggaccttagaaaggctaagtgatctttctctggctatccagctagtagtaatgaagtcaggtcttgaaccccggttctgctgactgaattggatgcactatagtacaggcttttagcaccgaagtgtggtcctcagaccagtgcctgccaaccagatgttactggtctgtgaggaaataagtacagatactgacaggaagcttttataaacaatttattggagtgtttttgtttctgttgggtctaattaaaaaaattggagcttgta

SEQ ID NO: 116813 - DNA, 1931 bp, Homo sapiens
  Payload ID: 2777
  Gene Symbol: CLN5
  Gene Name: ceroid-lipofuscinosis, neuronal 5
  Uniprot ID: O75503
  ENST ID: ENST00000616833
  CDS Start-End: 16-1092
actgggtgcagcctgatggcgcaggaggtagacacggcacagggcgccgagatgcggcggggcgcgggcgcggctcggggacgcgcttcctggtgctgggccctggcgctgctttggctcgcggtggttccgggctggtcccgggtctcgggcatcccctcccggcgccactggccggtgccctacaagcgctttgacttccgtccaaaacctgatccttattgtcaagctaagtatactttctgtccaactggctcacctatcccagttatggagggtgatgatgacattgaagtttttcgattacaagccccagtatgggaatttaaatatggagacctcctgggacacttgaaaattatgcatgatgccattggattcagaagtacattaactggcaagaactacacaatggaatggtatgaacttttccaacttggcaactgtacatttccccatctccgacctgaaatggatgcccctttctggtgtaatcaaggcgctgcctgcttttttgagggaattgatgatgttcactggaaggaaaatgggacattagttcaagtagcaactatatcaggaaacatgttcaaccaaatggcaaagtgggtgaaacaggacaatgaaacaggaatttattatgagacatggaatgtaaaagccagcccagaaaagggggcagagacatggtttgattcctacgactgttccaaatttgtgttaaggacctttaacaagttggctgaatttggagcagagttcaagaacatagaaaccaactatacaagaatatttctttacagtggagaacctacttatctgggaaatgaaacatctgtttttgggccaacaggaaacaagactcttggtttagccataaaaagattttattaccccttcaaaccacatttgccaactaaagaatttctgttgagtctcttgcaaatttttgatgcagtgattgtgcacaaacagttctatttgttttataattttgaatattggtttttacctatgaaattcccttttattaaaataacatatgaagaaatccctttacctatcagaaacaaaacactctctggtttataaaacaccttaattctactgctcttttttctccaatcaccagcatctgtttttcagggggtgattttacttttgtgaattccttagcctttcttccttggtgcataaagttaaaatgcacatcagcagaattgctgcatattaacatctcaggactcttctcttgtaaagaagctgaaattcgtactatattggccaaagtgagcgagttaggtgatcttggtttcaatttccgagcctttgttaatatggagaattatggttcatatcagttatgtaggacctttggacccagggtcctacagatagatatggtgtgcccagattttaaaaataccttcaaaaataaaaaatacattcagtgacattttcatggtgggagctcttctttctgatatggcagttacactttttcacttaagtgctttagtttagactaactttacaacttctataacttttggaaccaagtttagtatagtctgattacattccattcacctaactttagacattcgtttagacaccataactggagtgattgtgcttctagatgtggcaaatccagtgttaacacatatttctggctgagattttggaactagctagtaactggcttgtgttctttaagcatactaacatcactaaatcttaggatttaggattgctgtaaagatgtaagttgtgtatgtttggcaggtcacattgaatggcagtgataatgattaatcaaagaacaaatgtcatccttgatcttgcctaatgtagtttatgtgccaaactttccagggttttgtagtcacctagattttaagctgatagcatagtgcttcagcggttct

SEQ ID NO: 116814 - DNA, 710 bp, Homo sapiens
  Payload ID: 2777
  Gene Symbol: CLN5
  Gene Name: ceroid-lipofuscinosis, neuronal 5
  ENST ID: ENST00000485938
  CDS Start-End: 1-559
cacggcacagggcgccgagatgcggcggggcgcgggcgcggctcggggacgcgcttcctggtgctgggccctggcgctgctttggctcgcggtggttccgggctggtcccgggtctcgggcatcccctcccggcgccactggccggtgccctacaagcgctttgacttccgtccaaaacctgatccttattgtcaagctaagtatactttctgtccaactggctcacctatcccagttatggagggtgatgatgacattgaagtttttcgattacaagccccagtatgggaatttaaatatggagacctcctgggacacttgaaaattatgcatgatgccattggattcagaagtacattaactggcaagaactacacaatggaatggtatgaacttttccaacttggcaactgtacatttccccatctccgacctgaaatggatgcccctttctggtgtaatcaaggcgctgcctgcttttttgagggaattgatgatgttcactggaaggaaaatgggacattagttcaagtagcaactatatcaggtaagttgtgaaaatatagcaatatttgatcattgcatcaaaaaccaaatgaaagaaattgttatacttccattgaaacatttcagtaatgttttacttagaggtcatttgtaaaatgtacttttggaaccattaaactttgggaatttttttcatctctta

SEQ ID NO: 116815 - DNA, 2242 bp, Homo sapiens
  Payload ID: 2778
  Gene Symbol: CLN6
  Gene Name: ceroid-lipofuscinosis, neuronal 6, late infantile, variant
  Uniprot ID: Q9NWW5
  ENST ID: ENST00000249806
  CDS Start-End: 159-1094
gtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgcgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacagccccaa

SEQ ID NO: 116816 - DNA, 1343 bp, Homo sapiens
  Payload ID: 2778
  Gene Symbol: CLN6
  Gene Name: ceroid-lipofuscinosis, neuronal 6, late infantile, variant
  Uniprot ID: Q9NWW5
  ENST ID: ENST00000538696
  CDS Start-End: 239-1270
agaagtcaggccaggtgtctctctttcccttgggcccgcggcccaaccgcatggcaccaggcagcccccagcggtattgcgacctctgcgtcagtcgcgctcagtccctagatacaggtgtgccggagaagcccagggaagggatgcgtgaccatcactacaccctgccccacgacgcggtgggacgcgcaccctgaccctccccagagccgcgcccaggaccttgcctgggcggaaaatggcagccgttgccgggaaggagcggcgagcgagaggcaggccccggccagagacactgggagccatccctaggagggagggaggcgaggcgggcttgagccgagccttcaagccactggcgcaggcgccattgtcctgtgagacttcgctgagaaaactcaaattcaaaggtaaaaagcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagta

SEQ ID NO: 116817 - DNA, 945 bp, Homo sapiens
  Payload ID: 2778
  Gene Symbol: CLN6
  Gene Name: ceroid-lipofuscinosis, neuronal 6, late infantile, variant
  ENST ID: ENST00000567060
  CDS Start-End: 87-404
gaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtgtgtcttgtatatgtgtgcgcagagtgcatcattttcagactctactattt

SEQ ID NO: 116818 - DNA, 1074 bp, Homo sapiens
  Payload ID: 2778
  Gene Symbol: CLN6
  Gene Name: ceroid-lipofuscinosis, neuronal 6, late infantile, variant
  ENST ID: ENST00000565471
  CDS Start-End: 88-564
ggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctccttt

SEQ ID NO: 116819 - DNA, 981 bp, Homo sapiens
  Payload ID: 2778
  Gene Symbol: CLN6
  Gene Name: ceroid-lipofuscinosis, neuronal 6, late infantile, variant
  ENST ID: ENST00000566347
  CDS Start-End: 135-881
cgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagaga

SEQ ID NO: 116820 - DNA, 900 bp, Homo sapiens
  Payload ID: 2778
  Gene Symbol: CLN6
  Gene Name: ceroid-lipofuscinosis, neuronal 6, late infantile, variant
  ENST ID: ENST00000564752
  CDS Start-End: 126-767
cgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcg

SEQ ID NO: 116821 - DNA, 7113 bp, Homo sapiens
  Payload ID: 2779
  Gene Symbol: CLN8
  Gene Name: ceroid-lipofuscinosis, neuronal 8
  Uniprot ID: Q9UBY8
  ENST ID: ENST00000331222
  CDS Start-End: 248-1108
gtgcgcgggcggtgtttgaggccggccagtcgtgactgggcggcaatgaggtcagtgactgccgggagtcctgcaggggcggggcggcgccaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagcttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacagagcaagactctctctcaaaaaaaaaaaaaaaaaaaaattctagaccgaagtgtacggcagtgccatctggtggcaagtggtacaaagacaacgctgaggggtagtgactcctgtagcagcagagacgccttggagtttaacccccaccaaccagagcgtgggctggtaaagatgaaatcttgcaagttttttttttttttaaatcatggtacctgttttaaaatgagaagttattattcatactgtgttgctcatttgacaaaataaggtaaggatttcataatcaggttgtctgggtttcagagctgtttttaattgactgagttacctacaggcacccaatctagaccctaattctgtggttggtgttcctctgtagatttcaagacaagtagtgatgtcattttctccctgagctgtagggtggacctggacccctcagagatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggagcctggctttggctcccaggctggagtccagtggtgtgatctcggctcactgcaacctccacctcccgggttccagggattctcctgcctcaccctttcaagtagctgggattacaggtacctctaccatgcctggctgattttttgtatttttagtagagacagggtttcaccatgttggccaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgtttcttaagttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggccgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagcctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgggtggatcatttgaggtcaggagtttgaaaccagcctggccaacatggtgaaaccccatctctactaaaaaaacaaaactagctgggggtggtggtgcatgcctgtggtcccagctacttgggaggctaaggtagaagaattgcttgaacctgggaggcagagattgcagtgagccgagatcacgccattgcactccagcctgggtgacacagtgagactccatctcaaaaaaaaaaaaagaacggacatcatttctcacagttctggaggctggaagtccaagataaaggtgtgggctgattagtttctgctgggaacactgcatcctcacgtggtggaggggatggaaggtcaacaggcctcagctagttctccgctgcctttttatgaggcattaagccatttgcaagagtagggggccccacctcttaataccaccgcaatgacaattacaatgtcatgtgaattctggaggggacacggtcacactgcagcatcagcacccggtgaatgtggttctcttcccatgtccgaattttgtgagctccacacgggcagggttgcatctgttttattctctgattgattctaagccccatgtccctggcacaggatggctgcttggcagtagggagtggatgaaccagtagtacccagggctgccaggcagggccctgcaggggacagacccaagggctgatatggggacacctgctgaggggggaatttaccacggtaagggcagggctgggaggctgggcagccagtttcaccctcgcacaggctgcctggcaagaccagcggctggaggtgatgtcctcagtagagaacggtggccactggaaacgtgtggccagaaggggaaacgctcgggcctctggtgggggccagcctggggtggggtcggccagggtcagctgcctttccttcatgctggggaggagatgttgtgtgcatgtgagaaagcatttgatagcatgccaaaagtttcctccattatgtgcgtgtcaagtgtttgaccaggtcagaactcttgttctatgcgaatgtgctcacgcagacagaagcggaggggctccgtcgctctgccctcacgccgctgaaccgcgagggtctcccgctcctcaggcttgcggctcggccgcgaagtgtgtcaggtgtgcatcctgggtgctcctttgtgctctgtcctacggtgacacaggcggcgtggggttagacaggtaccggtcagactacggtgacacaggcggcgtgcggttagacaggtaccggtcagattacggtggcacaggcggcgtggggttagacaggtaccggtcagattacggtggcacaggcggcgtggggttagacaggtaccggtcagattacggtggcacaggcggcgtggggttagacaggtaccggtcagattacggtggcacaggcggcgtggggttagacaggtaccggtcagattacggtggcacaggcagcgtggggttagacaggtaccggtcagattacggtggcacaggcggcgtggggttagacaggtaccggtcagattacggtggcacaggcggcgtggggttagacaggtaccggtcagattacggtgacacaggcggcgtggggttagacaggtaccggtcagattacggtggcacaggctgcgtggggttagacaggtaccggtcagattacggtggcacaggcggcgtggggttagacaggtactggtcagatgcacgggctccctaaacccctgctgtggcttcggcagtaaagacaggacgcacccatgtcacaagaggagcacaggcaggggtgttggtgttggggcagccctcagggtctccagaccccagccccactcacacagcagcctaggaaggaagggcagagtcccaggtgtcagctggtgggtctcccaggagctgcccctccctggaagtcacaggacaggaatgacagatcagggaactgcaggaagctgccacctctggggtcagaatatgcccagcctgcgggggctctctatcggggtcttcgagagccagacagcctgccttgtgctgcatacctggctttgctctgtgcagaacccagcacacgtgattttgtgtgacatgccagcagcctggctcccaggacaggaggcctgccctgggggaggggctgcaggaggagggggggcaggcacccatgagtctgtccagccttgtcacagatgcatcgcccaccctgcggtcctgatttcagctcacctcagagtaaatcagaataaactgcacccagactttcacgaatgcatgttgacgctttcagttcacccctttctttgctaactttcttcctattttcttctaatgcgagagcttattaattccatatttatcattttgaataacttttctcctttttagtaacaaaatgtacttcactcttagtaaaatgtatttactattttagtaacaaaaatatacttgcctaatcatgtttaaaatatagtgatgtgaaaaattcaga

SEQ ID NO: 116822 - DNA, 7111 bp, Homo sapiens
  Payload ID: 2779
  Gene Symbol: CLN8
  Gene Name: ceroid-lipofuscinosis, neuronal 8
  Uniprot ID: Q9UBY8
  ENST ID: ENST00000619400
  CDS Start-End: 248-1108
gtgcgcgggcggtgtttgaggccggccagtcgtgactgggcggcaatgaggtcagtgactgccgggagtcctgcaggggcggggcggcgccaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagcttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacagagcaagactctctctcaaaaaaaaaaaaaaaaaaaaattctagaccgaagtgtacggcagtgccatctggtggcaagtggtacaaagacaacgctgaggggtagtgactcctgtagcagcagagacgccttggagtttaacccccaccaaccagagcgtgggctggtaaagatgaaatcttgcaagttttttttttttttaaatcatggtacctgttttaaaatgagaagttattattcatactgtgttgctcatttgacaaaataaggtaaggatttcataatcaggttgtctgggtttcagagctgtttttaattgactgagttacctacaggcacccaatctagaccctaattctgtggttggtgttcctctgtagatttcaagacaagtagtgatgtcattttctccctgagctgtagggtggacctggacccctcagagatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggagcctggctttggctcccaggctggagtccagtggtgtgatctcggctcactgcaacctccacctcccgggttccagggattctcctgcctcaccctttcaagtagctgggattacaggtacctctaccatgcctggctgattttttgtatttttagtagagacagggtttcaccatgttggccaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgtttcttaagttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggccgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagcctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgggtggatcatttgaggtcaggagtttgaaaccagcctggccaacatggtgaaaccccatctctactaaaaaaacaaaactagctgggggtggtggtgcatgcctgtggtcccagctacttgggaggctaaggtagaagaattgcttgaacctgggaggcagagattgcagtgagccgagatcacgccattgcactccagcctgggtgacacagtgagactccatctcaaaaaaaaaaaaagaacggacatcatttctcacagttctggaggctggaagtccaagataaaggtgtgggctgattagtttctgctgggaacactgcatcctcacgtggtggaggggatggaaggtcaacaggcctcagctagttctccgctgcctttttatgaggcattaagccatttgcaagagtagggggccccacctcttaataccaccgcaatgacaattacaatgtcatgtgaattctggaggggacacggtcacactgcagcatcagcacccggtgaatgtggttctcttcccatgtccgaattttgtgagctccacacgggcagggttgcatctgttttattctctgattgattctaagccccatgtccctggcacaggatggctgcttggcagtagggagtggatgaaccagtagtacccagggctgccaggcagggccctgcaggggacagacccaagggctgatatggggacacctgctgaggggggaatttaccacggtaagggcagggctgggaggctgggcagccagtttcaccctcgcacaggctgcctggcaagaccagcggctggaggtgatgtcctcagtagagaacggtggccactggaaacgtgtggccagaaggggaaacgctcgggcctctggtgggggccagcctggggtggggtcggccagggtcagctgcctttccttcatgctggggaggagatgttgtgtgcatgtgagaaagcatttgatagcatgccaaaagtttcctccattatgtgcgtgtcaagtgtttgaccaggtcagaactcttgttctatgcgaatgtgctcacgcagacagaagcggaggggctccgtcgctctgccctcacgccgctgaaccgcgagggtctcccgctcctcaggcttgcggctcggccgcgaagtgtgtcaggtgtgcatcctgggtgctcctttgtgctctgtcctacggtgacacaggcggcgtggggttagacaggtaccggtcagactacggtgacacaggcggcgtgcggttagacaggtaccggtcagattacggtggcacaggcggcgtggggttagacaggtaccggtcagattacggtggcacaggcggcgtggggttagacaggtaccggtcagattacggtggcacaggcggcgtggggttagacaggtaccggtcagattacggtggcacaggcggcgtggggttagacaggtaccggtcagattacggtggcacaggcagcgtggggttagacaggtaccggtcagattacggtggcacaggcggcgtggggttagacaggtaccggtcagattacggtggcacaggcggcgtggggttagacaggtaccggtcagattacggtgacacaggcggcgtggggttagacaggtaccggtcagattacggtggcacaggctgcgtggggttagacaggtaccggtcagattacggtggcacaggcggcgtggggttagacaggtactggtcagatgcacgggctccctaaacccctgctgtggcttcggcagtaaagacaggacgcacccatgtcacaagaggagcacaggcaggggtgttggtgttggggcagccctcagggtctccagaccccagccccactcacacagcagcctaggaaggaagggcagagtcccaggtgtcagctggtgggtctcccaggagctgcccctccctggaagtcacaggacaggaatgacagatcagggaactgcaggaagctgccacctctggggtcagaatatgcccagcctgcgggggctctctatcggggtcttcgagagccagacagcctgccttgtgctgcatacctggctttgctctgtgcagaacccagcacacgtgattttgtgtgacatgccagcagcctggctcccaggacaggaggcctgccctgggggaggggctgcaggaggagggggggcaggcacccatgagtctgtccagccttgtcacagatgcatcgcccaccctgcggtcctgatttcagctcacctcagagtaaatcagaataaactgcacccagactttcacgaatgcatgttgacgctttcagttcacccctttctttgctaactttcttcctattttcttctaatgcgagagcttattaattccatatttatcattttgaataacttttctcctttttagtaacaaaatgtacttcactcttagtaaaatgtatttactattttagtaacaaaaatatacttgcctaatcatgtttaaaatatagtgatgtgaaaaattca

SEQ ID NO: 116823 - DNA, 779 bp, Homo sapiens
  Payload ID: 2779
  Gene Symbol: CLN8
  Gene Name: ceroid-lipofuscinosis, neuronal 8
  ENST ID: ENST00000520991
  CDS Start-End: 247-779
ggcaatgaggtcagtgactgccgggagtcctgcaggggcggggcggcgccaagcgcagggagcccggctgagtggcagcccaggtgagcgctcagggagcccgggtgagggccgggaacccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggat

SEQ ID NO: 116824 - DNA, 759 bp, Homo sapiens
  Payload ID: 2779
  Gene Symbol: CLN8
  Gene Name: ceroid-lipofuscinosis, neuronal 8
  ENST ID: ENST00000632266
  CDS Start-End: 247-759
ggcaatgaggtcagtgactgccgggagtcctgcaggggcggggcggcgccaagcgcagggagcccggctgagtggcagcccaggtgagcgctcagggagcccgggtgagggccgggaacccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccc

SEQ ID NO: 116825 - DNA, 668 bp, Homo sapiens
  Payload ID: 2779
  Gene Symbol: CLN8
  Gene Name: ceroid-lipofuscinosis, neuronal 8
  ENST ID: ENST00000631624
  CDS Start-End: 429-668
aatgaactccatgcttgcagagtcatcttcagaatgagtcagctccgcttgtcccaggcaggagactcacgagttgatgtgaaatgcggattccctatgagacggaggacattgcatgtctcatcccatcacgaccgtgtgggtctcgttatttcataagagagggggaaaatgtgaattggaattttatttcctaagtactgttcttggtttctgaccagctgatcccaagtttcacatccttgtctgtgaagctaaactcaatgctgctgtgtgggaagaagatttgtaaagaaaactcttagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgca

SEQ ID NO: 116826 - DNA, 668 bp, Homo sapiens; identical to SEQ ID NO: 116825
  Payload ID: 2779
  Gene Symbol: CLN8
  Gene Name: ceroid-lipofuscinosis, neuronal 8
  ENST ID: ENST00000524258
  CDS Start-End: 429-668

SEQ ID NO: 116827 - DNA, 4676 bp, Homo sapiens
  Payload ID: 2780
  Gene Symbol: CP
  Gene Name: ceruloplasmin (ferroxidase)
  Uniprot ID: P00450
  ENST ID: ENST00000264613
  CDS Start-End: 264-3461
agagttatgcacaccctaatgcctccaacaataactgttgactttttattttcagtcagagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggaacccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccaccttaaaaaa

SEQ ID NO: 116828 - DNA, 3411 bp, Homo sapiens
  Payload ID: 2780
  Gene Symbol: CP
  Gene Name: ceruloplasmin (ferroxidase)
  ENST ID: ENST00000481169
  CDS Start-End: 36-2876
ttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggaacccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcatcttctgagactcacaggagaatatggaatgtgatctacccaatcacagtcagtgtgattattttattccaaatatctaccaaggaatgaccaggagaataagatcctccgatgttcgcaatggtgtggtgtcaggaggctgcctcttagacaatctccagatgtactgtgatgtgagtttgaaaaagagttcctgaagtaccacatctgggagacatgccactagctgagcttcccaaaagtctaccaagagctgaggaattgtatcttcatccttagcacaaagcaccttaaaaacagtaaaaggagcctctatattccagataaatatagcactgataaagcgacagctgggctgaatatcacagcatcacatgggccacgcaatcaataatttaccattagcattagcgccatggcaaaagcaaatttagacatttttaaaaggaaacagattctaggatgtacaaataaagtttctacagatatagtcttttaattagtacttttatcttataaactgattatgtatgtctgttttttcaataaacaaacaaatgaaaaactca

SEQ ID NO: 116829 - DNA, 1150 bp, Homo sapiens
  Payload ID: 2780
  Gene Symbol: CP
  Gene Name: ceruloplasmin (ferroxidase)
  ENST ID: ENST00000479771
  CDS Start-End: 1-678
ggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagcatcttctgagactcacaggagaatatggaatgtgatctacccaatcacagtcagtgtgattattttattccaaatatctaccaaggaatgaccaggagaataagatcctccgatgttcgcaatggtgtggtgtcaggaggctgcctcttagacaatctccagatgtactgtgatgtgagtttgaaaaagagttcctgaagtaccacatctgggagacatgccactagctgagcttcccaaaagtctaccaagagctgaggaattgtatcttcatccttagcacaaagcaccttaaaaacagtaaaaggagcctctatattccagataaatatagcactgataaagcgacagctgggctgaatatcacagcatcacatgggccacgcaatcaataatttaccattagcattagcgccatggcaaaagcaaatttagacatttttaaaaggaaacagattctaggatgtacaaataaagtttctacagatatagtcttttaattagtacttttatcttataaactgattatgtatgtctgttttttcaataaacaaacaaatgaa

SEQ ID NO: 116830 - DNA, 2806 bp, Homo sapiens
  Payload ID: 2780
  Gene Symbol: CP
  Gene Name: ceruloplasmin (ferroxidase)
  ENST ID: ENST00000494544
  CDS Start-End: 1-2559
gtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggaacccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaaggtgaatatccagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtct

SEQ ID NO: 116831 - DNA, 571 bp, Homo sapiens
  Payload ID: 2780
  Gene Symbol: CP
  Gene Name: ceruloplasmin (ferroxidase)
  ENST ID: ENST00000455472
  CDS Start-End: 36-571
ttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacaggtttccaaaacaaatggtacagtgaagatgtcactataagcaggcctaatgaccaagaagaaataacagctcaaatcctgaccaaaaaactagacaacaaagaacattccaccttacgggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacac

SEQ ID NO: 116832 - DNA, 2037 bp, Homo sapiens
  Payload ID: 2781
  Gene Symbol: FIGF
  Gene Name: c-fos induced growth factor (vascular endothelial growth factor D)
  Uniprot ID: O43915
  ENST ID: ENST00000297904
  CDS Start-End: 431-1495
caaaaaagtttcaatccagagttgggttccagctttctgtagctgtaagcattggtggccacaccacctccttacaaagcaactagaacctgcggcatacattggagagatttttttaattttctggacatgaagtaaatttagagtgctttctaatttcaggtagaagacatgtccaccttctgattatttttggagaacattttgatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaagcgatcatctcagtccacattggaacgatctgaacagcagatcagggctgcttctagtttggaggaactacttcgaattactcactctgaggactggaagctgtggagatgcaggctgaggctcaaaagttttaccagtatggactctcgctcagcatcccatcggtccactaggtttgcggcaactttctatgacattgaaacactaaaagttatagatgaagaatggcaaagaactcagtgcagccctagagaaacgtgcgtggaggtggccagtgagctggggaagagtaccaacacattcttcaagcccccttgtgtgaacgtgttccgatgtggtggctgttgcaatgaagagagccttatctgtatgaacaccagcacctcgtacatttccaaacagctctttgagatatcagtgcctttgacatcagtacctgaattagtgcctgttaaagttgccaatcatacaggttgtaagtgcttgccaacagccccccgccatccatactcaattatcagaagatccatccagatccctgaagaagatcgctgttcccattccaagaaactctgtcctattgacatgctatgggatagcaacaaatgtaaatgtgttttgcaggaggaaaatccacttgctggaacagaagaccactctcatctccaggaaccagctctctgtgggccacacatgatgtttgacgaagatcgttgcgagtgtgtctgtaaaacaccatgtcccaaagatctaatccagcaccccaaaaactgcagttgctttgagtgcaaagaaagtctggagacctgctgccagaagcacaagctatttcacccagacacctgcagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgtttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccattattcaagccatataa

SEQ ID NO: 116833 - DNA, 4495 bp, Homo sapiens
  Payload ID: 2782
  Gene Symbol: CGGBP1
  Gene Name: CGG triplet repeat binding protein 1
  Uniprot ID: Q9UFW8
  ENST ID: ENST00000309534
  CDS Start-End: 463-966
aatgctgctcggcggttgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggagatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgacaggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggatggtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacgaaaagatacacaatcattctgttttttgaaattccatgtgattcaaactgctccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttccacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttaccccagctaccgttaaatgaggacaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaaagattttgaaagcacattttgttttgtgagtcaatgacaaatatatttcctgattacaaaacagcagaa

SEQ ID NO: 116834 - DNA, 5298 bp, Homo sapiens
  Payload ID: 2782
  Gene Symbol: CGGBP1
  Gene Name: CGG triplet repeat binding protein 1
  Uniprot ID: Q9UFW8
  ENST ID: ENST00000398392
  CDS Start-End: 1334-1837
tttatcgtacttttcagaatttctgtggaatgtttaatcttctggatccatgactgtctgatacgttggcaatttaaagtccttttgaaagagagttcatgttacccagctattctctagtatgtattcatggaatactccatcgtttctgattacacttatgagacataattcttcagagcacacttagaattatttctctaacatatttatgcagacagaattccatcttgaattttatcaaattcactttaacttcttaagtcttggttattgtaagagcccaaaggtatggccccagggaacaattaagacttgatgatttgtcacctaccaaaatatgttcattatgtaaaggtttcaatgcccataaggctgtcatttggtatttagtgcagtgctcataaaagtgtgttattaggataaattgagaaattaattaagctgcttctagattaaataaatataaatatttggacaaatattgaagatacgtactttttccatcaaattttaattgaggttctgctgtatactagactctatgttcttgattttgttcttactagttaagtgaagtaagtattaacaaatgtaattattaattttaatgggaaaaggaaacaagtattagagaagtaagactttgcatatcttaacaccttttggaaaacggaggtatacatgcattacaaaataactttgaactgtatattttggctttacaatttaatgtcattgttgcttttagttgtatttggtctggtttttttttgtggtttttcctcagaacaattttggaaactatattcatcttcatatagaattatggcagtttataggcccacctgtttgaaaaaactttatccacagttgtgttcctaaaatcagttgtcccagaattgtgacaggaaagaagctcttttgaacttgaatgcatatctaagttagatgagattaatacaatttatatcctgaatgtaatttatatcctaaatgttgaactgtgattaggtttccctaaataatggtgacatctgggatagtttgagttctttctttatagtctaatttacttgaatttcgtaaaaatcaaggaatggacctgattgcgactggttagtaacttgttctagttttgccttcccttatatatttcaggtaagttaagattaatagacacacagtctactaatttgaattaagttttttgaagtatttgaagtgtttatatactgccttttattgttcattacttccagaatgaactgttgttataatactcatctttgtttcttttgtcttgaaagaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggagatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgacaggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggatggtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacgaaaagatacacaatcattctgttttttgaaattccatgtgattcaaactgctccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttccacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttaccccagctaccgttaaatgaggacaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaaa

SEQ ID NO: 116835 - DNA, 1063 bp, Homo sapiens
  Payload ID: 2782
  Gene Symbol: CGGBP1
  Gene Name: CGG triplet repeat binding protein 1
  Uniprot ID: Q9UFW8
  ENST ID: ENST00000462901
  CDS Start-End: 513-1016
aaacgcagtgccctcacttgtggttccgggctggggacggagtgaagtcccacgtatctcaattaagggaagtgctgggtttatatggagaacatagactatccgcaagggagctggttaccgaaagagaagtccctcctccaaaagagcgccttggagggctgcgcaggtgcagatacctctactaagaagacagaagacttactttcatcatctgaatcaaatccaaagagtgtctgacatttcttttgtgcaagatgagcctcaagtgcttctgcattacataaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaa

SEQ ID NO: 116836 - DNA, 556 bp, Homo sapiens
  Payload ID: 2782
  Gene Symbol: CGGBP1
  Gene Name: CGG triplet repeat binding protein 1
  ENST ID: ENST00000467332
  CDS Start-End: 238-556
agtgctgggtttatatggagaacatagactatccgcaagggagctggttaccgaaagagaagtccctcctccaaaagagcgccttggagggctgcgcaggtgcagatacctctactaagaagacagaagacttactttcatcatctgaatcaaatccaaagagtgtctgacatttcttttgtgcaagatgagcctcaagtgcttctgcattacaaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggact

SEQ ID NO: 116837 - DNA, 1147 bp, Homo sapiens
  Payload ID: 2782
  Gene Symbol: CGGBP1
  Gene Name: CGG triplet repeat binding protein 1
  Uniprot ID: Q9UFW8
  ENST ID: ENST00000482016
  CDS Start-End: 585-1088
aaaccggccgtctgttggtcaatgctgctcggcggttgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaatttctgtggaatgtttaatcttctggatccatgactgtctgatacgttggcaatttaaagtccttttgaaagagagttcatgttacccagctattctctaaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttga

SEQ ID NO: 116838 - DNA, 1393 bp, Homo sapiens
  Payload ID: 2783
  Gene Symbol: CRCP
  Gene Name: CGRP receptor component
  Uniprot ID: O75575
  ENST ID: ENST00000338592
  CDS Start-End: 114-461
gagcaccttggcgcgcggagctggcaccttggcgctgttggtggcggcggagacagctgtgaagtgtgaggttctttgtctgctggcagctaggggcgacgaggcgggacgtcatggaagtgaaggatgccaattctgcgcttctcagtaactacgagacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacgggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaa

SEQ ID NO: 116839 - DNA, 3139 bp, Homo sapiens
  Payload ID: 2783
  Gene Symbol: CRCP
  Gene Name: CGRP receptor component
  ENST ID: ENST00000360415
  CDS Start-End: 360-488
ggttgcagtaagccgagatccagcctgggcgacagagcgagactccgtctcaaaaaaaaaaaaaggttaaagaaaaaaagaaaagaaaacacaagataatcctgtccgcaaacgcttagcagtcttaaatcggcctggtggaaggatgcagggacactcccccaccctgccccccgaaaaaggggaacgcgcagcgcgaggttccgggtccgccaagctcccggcatgcagcgcggcgatcccggcgagcaccttggcgcgcggagctggcaccttggcgctgttggtggcggcggagacagctgtgaagtgtgaggttctttgtctgctggcagctaggggcgacgaggcgggacgtcatggaagtgaaggatgccaattctgcgcttctcagtaactacgagatggagtctcgctctgtcacccaggctggagtacagtggcaccatccaggctcactgcaacctctgcctcccggattcaagtgattctcctgcctcagcctcccgagtagctgggactacaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacgggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccgtccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaaccggggaggcagaggttgcagtgagccagatcgtgcattgcactccagcctggccgacagggtgagactccatctcaaaaaagagaaagtaccagattgtacttttaaatctgtctagcgtattgagaattttagtgggagctgttgatttatttctcagggcatacatgtgccaatctgtctcattgttgtctctctcttttttttttttttttttgagacagtctcgctgtgttgcccaggagtgcagtggcacgatctctgctcactgcaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgaggctaaaa

SEQ ID NO: 116840 - DNA, 3009 bp, Homo sapiens
  Payload ID: 2783
  Gene Symbol: CRCP
  Gene Name: CGRP receptor component
  Uniprot ID: O75575
  ENST ID: ENST00000395326
  CDS Start-End: 359-805
gttgcagtaagccgagatccagcctgggcgacagagcgagactccgtctcaaaaaaaaaaaaaggttaaagaaaaaaagaaaagaaaacacaagataatcctgtccgcaaacgcttagcagtcttaaatcggcctggtggaaggatgcagggacactcccccaccctgccccccgaaaaaggggaacgcgcagcgcgaggttccgggtccgccaagctcccggcatgcagcgcggcgatcccggcgagcaccttggcgcgcggagctggcaccttggcgctgttggtggcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacgggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaggccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccgtccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaaccggggaggcagaggttgcagtgagccagatcgtgcattgcactccagcctggccgacagggtgagactccatctcaaaaaagagaaagtaccagattgtacttttaaatctgtctagcgtattgagaattttagtgggagctgttgatttatttctcagggcatacatgtgccaatctgtctcattgttgtctctctcttttttttttttttttttgagacagtctcgctgtgttgcccaggagtgcagtggcacgatctctgctcactgcaacctctgcctcccagattcaagcgattctggtgccttagcctcctgagtagctgggacttacaggcacgtaccactataccctgctaaaatttgtatttttagtagagacagggttttgccatattggccaggctagtcgtaatgtctctttttaacactgaatatgttaggtggtttttcttgatggatttagggttaacctagttaataataaattgtttccaggtaattatcaagttttgtcattttataaatctgaagagttaatattgtcatcgatacaaataaagtgaaatctgactgag

SEQ ID NO: 116841 - DNA, 492 bp, Homo sapiens
  Payload ID: 2783
  Gene Symbol: CRCP
  Gene Name: CGRP receptor component
  Uniprot ID: O75575
  ENST ID: ENST00000398684
  CDS Start-End: 123-338
gatcccggcgagcaccttggcgcgcggagctggcaccttggcgctgttggtggcggcggagacagctgtgaagtgtgaggttctttgtctgctggcagctaggggcgacgaggcgggacgtcatggaagtagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaa

SEQ ID NO: 116842 - DNA, 942 bp, Homo sapiens
  Payload ID: 2783
  Gene Symbol: CRCP
  Gene Name: CGRP receptor component
  Uniprot ID: O75575
  ENST ID: ENST00000431089
  CDS Start-End: 4-429
ggcatgcagcgcggcgatcccggcgagcaccttggcgcgcggagctggcaccttggcgctgttggtggcggcggagacagctgtgaagtgaaggatgccaattctgcgcttctcagtaactacgagacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccgg

SEQ ID NO: 116843 - DNA, 566 bp, Homo sapiens
  Payload ID: 2784
  Gene Symbol:
  Gene Name: CH17-140K24.5
  ENST ID: ENST00000623407
  CDS Start-End: 152-292
aagaatagctgagccagagcgaacgtgagtgtgaaacctctttaagacaccgttgggctgcttggttctgacattctggactgcaaaacagttctactaggatcctggggatacatgaagcttctgtgaaccaacttttcaagaaaaagcaatggagattggatggatgcacaatcggagacaaagcaatgaagaatttttaaataaacacaaaaattgggcacagccatttgactgtgttggaagccacaaggtggcgctgcagactgaagagacggaggaacaaaattgaccagaatgctacggaagtccttgacaaaaaggaaacactgagacagatgggctgagaagaagagctgtcgagtccctgattgggaaaggaaaaattaaaaaccctagatctctggtacacataagtctgggtttgcgattgctatttgtgctggggcagtgtgattgagactgacattgaggaaagaagcagctatgaagaccagggggttcagctttccaagacaaaggtgcactggacagagagagcaaagctgagtacaacatcaccatca

SEQ ID NO: 116844 - DNA, 566 bp, Homo sapiens
  Payload ID: 2784
  Gene Symbol:
  Gene Name: CH17-140K24.5
  ENST ID: ENST00000623884
  CDS Start-End: 132-272
gaacgtgagtgtgaaacctctttaagacaccgttgggctgcttggttctgacattctggactgcaaaacagttctactaggatcctggggatacatgaagcttctgtgaaccaacttttcaagaaaaagcaatggagattggatggatgcacaatcggagacaaagcaatgaagaatttttaaataaacacaaaaattgggcacagccatttgactgtgttggaagccacaaggtggcgctgcagactgaagagacggaggaacaaaattgaccagaatgctacggaagtccttgacaaaaaggaaacactgagacagatgggctgagaagaagagctgtcgagtccctgattgggaaaggaaaaattaaaaaccctagatctctggtacacataagtctgggtttgcgattgctatttgtgctggggcagtgtgattgagactgacattgaggaaagaagcagctatgaagaccagggggttcagctttccaagacaaaggcaagtcctgtttctttttcttttctggggagtgtccttggcaggttctgggtttggacgttatt

SEQ ID NO: 116845 - DNA, 548 bp, Homo sapiens
  Payload ID: 2785
  Gene Symbol:
  Gene Name: CH17-140K24.8
  ENST ID: ENST00000624396
  CDS Start-End: 135-242
gcattaaaggagcttcgcctacagagctgctggaggatacactctccagggggttcctgttaaaaaccagagcttcagcttccaaaattacggctgagcttcagtttttccacaagagattgcctaaaggaaccatggagatcagaggggcactcgatctgcgaaaaaggttatcaacgcacagatcgatcactgcctctgtcccatcgctccctgaagtagctctgactccggttccttgaaaggggcgtgtacagaagtaaagatggagcctgcaggggagcgctttcccgaacaaaggcaagtcctgattctccttcttttactggaagtgactctggcaggctgggaaccccgtcgctattctgtgatggaggaaacagagagaggttcttttgtagccaacctggccaatgacctagggctgggagtgggggagctagccgagcggggagcccgggtagtttctgaggataacgaacaaggcttgcagcttgatctgcagaccgggcagttgatattaaatgagaagctggaccgggagaagc

SEQ ID NO: 116846 - DNA, 353 bp, Homo sapiens
  Payload ID: 2786
  Gene Symbol:
  Gene Name: CH17-212P11.5
  ENST ID: ENST00000615784
  CDS Start-End: 1-353
atggactgcacctggaggatcctcctcttggtggcagcagctacaggcacccacgccgaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaacaga

SEQ ID NO: 116847 - DNA, 353 bp, Homo sapiens; identical to SEQ ID NO: 116846
  Payload ID: 2786
  Gene Symbol:
  Gene Name: CH17-212P11.5
  ENST ID: ENST00000632209
  CDS Start-End: 1-353

SEQ ID NO: 116848 - DNA, 356 bp, Homo sapiens
  Payload ID: 2787
  Gene Symbol:
  Gene Name: CH17-212P11.6
  ENST ID: ENST00000632052
  CDS Start-End: 1-356
atggctcctcaccatggacaggacctagagctaatcttcctggtggcagcagctacaggtaaggtgcagctggggcagtctgaggctgaggtgaagaagcctggggcctcagtgaaggtctcctgcaaggcttccggatacaccttcacctactgctccttgcactggttgcaacaggcccctggacaagggcttgaaaggatgagatggatcacactttacaatggtaacaccaactatgcaaagaagttccagggcagagtcaccattaccagggacatgtccctgaggacagcctacatagagctgagcagcctgagatctgaggactcggctgtgtattactgggcaagata

SEQ ID NO: 116849 - DNA, 356 bp, Homo sapiens
  Payload ID: 2787
  Gene Symbol:
  Gene Name: CH17-212P11.6
  ENST ID: ENST00000632507
  CDS Start-End: 1-356
atggctcctcaccatggacaggacctagagctaatcttcctggtggcagcagctacaggtaaggtgcagctggggcagtctgaggctgaggtaaagaagcctggggcctcagtgaaggtctcctgcaaggcttccggatacaccttcacttgctgctccttgcactggttgcaacaggcccctggacaagggcttgaaaggatgagatggatcacactttacaatggtaacaccaactatgcaaagaagttccagggcagagtcaccattaccagggacatgtccctgaggacagcctacatagagctgagcagcctgagatctgaggactcggctgtgtattactgggcaagata

SEQ ID NO: 116850 - DNA, 353 bp, Homo sapiens
  Payload ID: 2788
  Gene Symbol:
  Gene Name: CH17-224D4.1
  ENST ID: ENST00000632099
  CDS Start-End: 1-353
atggagttctggctgagctgggttctccttgttgccattttaaaagatgtccagtgtgaggtgcagctggtggagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactccgtgaagggcagattcaccatctccagagacaattccaagaacacgctgtatcttcaaatgagcagtctgagagctgaggacacggctgtgtattactgtgtgaaaga

SEQ ID NO: 116851 - DNA, 353 bp, Homo sapiens; identical to SEQ ID NO: 116850
  Payload ID: 2788
  Gene Symbol:
  Gene Name: CH17-224D4.1
  ENST ID: ENST00000632333
  CDS Start-End: 1-353

SEQ ID NO: 116852 - DNA, 353 bp, Homo sapiens
  Payload ID: 2789
  Gene Symbol:
  Gene Name: CH17-224D4.2
  ENST ID: ENST00000632950
  CDS Start-End: 1-353
atggggtcaaccgccatcctcgccctcctcctggctgttctccaaggagtctgtgccgaagtgcagctggtgcagtccggagcagaggtgaaaaagcccggggagtctctgaggatctcctgtaagggttctggatacagctttaccagctactggatcagctgggtgcgccagatgcccgggaaaggcctggagtggatggggaggattgatcctagtgactcttataccaactacagcccgtccttccaaggccacgtcaccatctcagctgacaagtccatcagcactgcctacctgcagtggagcagcctgaaggcctcggacaccgccatgtattactgtgcgagaca

SEQ ID NO: 116853 - DNA, 353 bp, Homo sapiens; identical to SEQ ID NO: 116852
  Payload ID: 2789
  Gene Symbol:
  Gene Name: CH17-224D4.2
  ENST ID: ENST00000633752
  CDS Start-End: 1-353

SEQ ID NO: 116854 - DNA, 402 bp, Homo sapiens
  Payload ID: 2790
  Gene Symbol:
  Gene Name: CH17-262H11.1
  ENST ID: ENST00000631943
  CDS Start-End: 50-402
acaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatctgcagcctaaaggctgaggacactgccgtgtattactgtgcgagaga

SEQ ID NO: 116855 - DNA, 402 bp, Homo sapiens; identical to SEQ ID NO: 116854
  Payload ID: 2790
  Gene Symbol:
  Gene Name: CH17-262H11.1
  ENST ID: ENST00000633833
  CDS Start-End: 50-402

SEQ ID NO: 116856 - DNA, 192 bp, Homo sapiens
  Payload ID: 2791
  Gene Symbol:
  Gene Name: CH17-270A2.2
  ENST ID: ENST00000625258
  CDS Start-End: 62-192
cgattcccatccttacgaccgaggaaaaaagaatgtggagcgttattcagacaaatatcagatgtcaggtccgattgacaatgccatcgattggaaccctgattggcggcgtctaccccgggagctaaagatccgagtgcggaagctacagaaggaacggattacaattctgctccccaagaggccccctaa

SEQ ID NO: 116857 - DNA, 699 bp, Homo sapiens; identical to SEQ ID NO: 103627
  Payload ID: 2792
  Gene Symbol:
  Gene Name: CH17-5A7.1
  ENST ID: ENST00000617392
  CDS Start-End: 1-699

SEQ ID NO: 116858 - DNA, 462 bp, Homo sapiens; identical to SEQ ID NO: 103623
  Payload ID: 2792
  Gene Symbol:
  Gene Name: CH17-5A7.1
  ENST ID: ENST00000620107
  CDS Start-End: 1-462

SEQ ID NO: 116859 - DNA, 984 bp, Homo sapiens
  Payload ID: 2792
  Gene Symbol:
  Gene Name: CH17-5A7.1
  ENST ID: ENST00000632371
  CDS Start-End: 1-655
cacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtatcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcag

SEQ ID NO: 116860 - DNA, 1547 bp, Homo sapiens
  Payload ID: 2792
  Gene Symbol:
  Gene Name: CH17-5A7.1
  ENST ID: ENST00000634011
  CDS Start-End: 412-1521
acccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaa

SEQ ID NO: 116861 - DNA, 1522 bp, Homo sapiens
  Payload ID: 2792
  Gene Symbol:
  Gene Name: CH17-5A7.1
  ENST ID: ENST00000631590
  CDS Start-End: 308-1006
gtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaa

SEQ ID NO: 116862 - DNA, 354 bp, Homo sapiens
  Payload ID: 2793
  Gene Symbol:
  Gene Name: CH17-60O17.5
  ENST ID: ENST00000616593
  CDS Start-End: 1-354
atgaaacacctgtggttcttcctcctcctggtggcagctcccagatgggtcctgtcccagctgcagctgcaggagtcgggcccaggactggtgaagccttcacagaccctgtccctcacctgcactgtctctggtggctccatcagcagtggtgattactactggagctggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgccaga

SEQ ID NO: 116863 - DNA, 349 bp, Homo sapiens
  Payload ID: 2793
  Gene Symbol:
  Gene Name: CH17-60O17.5
  ENST ID: ENST00000633570
  CDS Start-End: 1-349
atgaaacacctgtggttcttcctcctgctggtggcagctcccagatgggtcctgtcccagctgcagctgcaggagtcgggcccaggactggtgaagccttcacagaccctgtccctcacctgcactgtctctggtggctccatcagcagtggtgattactactggagctggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtg

SEQ ID NO: 116864 - DNA, 353 bp, Homo sapiens
  Payload ID: 2794
  Gene Symbol:
  Gene Name: CH17-60O17.7
  ENST ID: ENST00000631869
  CDS Start-End: 1-353
atggagtttgggctgagctgggttttcctcgttgctcttttaagaggtgtccagtgtcaggtgcagctggtggagtctgggggaggcgtggtccagcctggggggtccctgagactctcctgtgcagcgtctggattcaccttcagtagctatggcatgcactgggtccgccaggctccaggcaaggggctggagtgggtggcatttatacggtatgatggaagtaataaatactatgcagactccgtgaagggccgattcaccatctccagagacaattccaagaacacgctgtatctgcaaatgaacagcctgagagctgaggacacggctgtgtattactgtgcgaaaga

SEQ ID NO: 116865 - DNA, 4705 bp, Homo sapiens
  Payload ID: 2795
  Gene Symbol:
  Gene Name: CH507-42P11.8
  ENST ID: ENST00000613488
  CDS Start-End: 134-2485
atgcggcgcggccccggaggcagcagcagcggcggcggcagccggagcagtaggcacccgagcagcgccagcggccgagcgggcggcttcctggcctgggcgctccggtggcggcggaggtgcgcgcggagccatggttatcatgtcggagttcagcgcggaccccgcgggccagggtcagggccagcagaagcccctccgggtgggtttttacgacatcgagcggaccctgggcaaaggcaacttcgcggtggtgaagctggcgcggcatcgagtcaccaaaacgcaggttgcaataaaaataattgataaaacacgattagattcaagcaatttggagaaaatctatcgtgaggttcagctgatgaagcttctgaaccatccacacatcataaagctttaccaggttatggaaacaaaggacatgctttacatcgtcactgaatttgctaaaaatggagaaatgtttgattatttgacttccaacgggcacctgagtgagaacgaggcgcggaagaagttctggcaaatcctgtcggccgtggagtactgtcacgaccatcacatcgtccaccgggacctcaagaccgagaacctcctgctggatggcaacatggacatcaagctggcagattttggatttgggaatttctacaagtcaggagagcctctgtccacgtggtgtgggagccccccgtatgccgccccggaagtctttgaggggaaggagtatgaaggcccccagctggacatctggagcctgggcgtggtgctgtacgtcctggtctgcggttctctccccttcgatgggcctaacctgccgacgctgagacagcgggtgctggagggccgcttccgcatccccttcttcatgtctcaagactgtgagagcctgatccgccgcatgctggtggtggaccccgccaggcgcatcaccatcgcccagatccggcagcaccggtggatgcgggctgagccctgcttgccgggacccgcctgccccgccttctccgcacacagctacacctccaacctgggcgactacgatgagcaggcgctgggtatcatgcagaccctgggcgtggaccggcagaggacggtggagtcactgcaaaacagcagctataaccactttgctgccatttattacctcctccttgagcggctcaaggagtatcggaatgcccagtgcgcccgccccgggcctgccaggcagccgcggcctcggagctcggacctcagtggtttggaggtgcctcaggaaggtctttccaccgaccctttccgacctgccttgctgtgcccgcagccgcagaccttggtgcagtccgtcctccaggccgagatggactgtgagctccagagctcgctgcagtggcccttgttcttcccggtggatgccagctgcagcggagtgttccggccccggcccgtgtccccaagcagcctgctggacacagccatcagtgaggaggccaggcaggggccgggcctagaggaggagcaggacacgcaggagtccctgcccagcagcacgggccggaggcacaccctggccgaggtctccacccgcctctccccactcaccgcgccatgtatagtcgtctccccctccaccacggcaagtcctgcagagggaaccagctctgacagttgtctgaccttctctgcgagcaaaagccccgcggggctcagtggcaccccggccactcaggggctgctgggcgcctgctccccggtcaggctggcctcgcccttcctggggtcgcagtccgccaccccagtgctgcaggctcaggggggcttgggaggagctgttctgctccctgtcagcttccaggagggacggcgggcgtcggacacctcactgactcaagggctgaaggcctttcggcagcagctgaggaagaccacgcggaccaaagggtttctgggactgaacaaaatcaaggggctggctcgccaggtgtgccaggtccctgccagccgggccagcaggggcggcctgagccccttccacgcccctgcacagagcccaggcctgcacggcggcgcagccggcagccgggagggctggagcctgctggaggaggtgctagagcagcagaggctgctccagttacagcaccacccggccgctgcacccggctgctcccaggccccccagccggcccctgccccgtttgtgatcgccccctgtgatggccctggggctgccccgctccccagcaccctcctcacgtcggggctcccgctgctgccgcccccactcctgcagaccggcgcgtccccggtggcctcagcggcgcagctcctggacacacacctgcacattggcaccggccccaccgccctccccgctgtgcccccaccacgcctggccaggctggccccaggttgtgagcccctggggctgctgcagggggactgtgagatggaggacctgatgccctgctccctaggcacgtttgtcctggtgcagtgagggcagccctgcatcctggcacggacactgactcttacagcaataacttcagaggaggtgaagacatctggcctcaaagccaagaactttctagaagcgaaataagcaatacgttaggtgttttggctttttagtttatttttgttttatttttttcttgcactgagtgacctcaactttgagtagggactggaaactttaggaagaaagataattgaggggcgtgtctgggggcgggggcaggaggggagcggggtggagggaacacgtgcagtgccgtggtgtggggatctcggcccctctctctgggttcgtcgtggttgagatgattacctcggacgtctacggaaacgagcgggcgcattgttgtccgcttgtgtgtgtgtgtgtgtgtgtgtgtgtgcgcgtacattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactacacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctttggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaattgattccaacacaaaactccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagacactacgtgatctgattgagatgtacatagtttttttttttaccataactgaattattttatctcttatgttaacatgagaaatgtatgccaaatgattagttgatgtatgttttttaatttaatatttaaataaaatatttggaag

SEQ ID NO: 116866 - DNA, 1162 bp, Homo sapiens
  Payload ID: 2796
  Gene Symbol:
  Gene Name: CH507-9B2.1
  ENST ID: ENST00000612610
  CDS Start-End: 188-1117
gacacggctgcctccagcacaccgcgcgctgggcgctcagagcctcgggcgcggcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactgaatcctggaacctgctccttctgctctcgtgactgactgtgttctctatgcaacttccaataaaacctcttcatttg

SEQ ID NO: 116867 - DNA, 816 bp, Homo sapiens
  Payload ID: 2796
  Gene Symbol:
  Gene Name: CH507-9B2.1
  ENST ID: ENST00000620481
  CDS Start-End: 188-766
gacacggctgcctccagcacaccgcgcgctgggcgctcagagcctcgggcgcggcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactgaatcctggaacctgctccttctgctctcgtgactgactgtgttctctatgcaacttccaataaaacctcttcatttgaaagg

SEQ ID NO: 116868 - DNA, 3274 bp, Homo sapiens
  Payload ID: 2796
  Gene Symbol:
  Gene Name: CH507-9B2.1
  ENST ID: ENST00000623960
  CDS Start-End: 187-1095
acacggctgcctccagcacaccgcgcgctgggcgctcagagcctcgggcgcggcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgggcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagagatcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaa

SEQ ID NO: 116869 - DNA, 998 bp, Homo sapiens
  Payload ID: 2796
  Gene Symbol:
  Gene Name: CH507-9B2.1
  ENST ID: ENST00000623903
  CDS Start-End: 150-383
agagcctcgggcgcggcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgc

SEQ ID NO: 116870 - DNA, 2238 bp, Homo sapiens
  Payload ID: 2796
  Gene Symbol:
  Gene Name: CH507-9B2.1
  ENST ID: ENST00000623795
  CDS Start-End: 148-705
agcctcgggcgcggcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgggcctttaggtgaatgtgggatccactcccgcttttaacatgaaagcattagaag

SEQ ID NO: 116871 - DNA, 513 bp, Homo sapiens
  Payload ID: 2797
  Gene Symbol:
  Gene Name: CH507-9B2.2
  ENST ID: ENST00000624081
  CDS Start-End: 1-468
gtggaggagtggggacccttcgatcttgtgtacggcgccacacctcccctgggccacacctgtgaccgtcctcccagctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaag

SEQ ID NO: 116872 - DNA, 45 bp, Homo sapiens
  Payload ID: 2798
  Gene Symbol:
  Gene Name: CH507-9B2.3
  ENST ID: ENST00000627754
  CDS Start-End: 1-45
atgtatcatttcctcaagcaaagttgcctcctgagtagctgggat

SEQ ID NO: 116873 - DNA, 1599 bp, Homo sapiens
  Payload ID: 2799
  Gene Symbol:
  Gene Name: CH507-9B2.4
  ENST ID: ENST00000623476
  CDS Start-End: 1-839
ttgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgtta

SEQ ID NO: 116874 - DNA, 3264 bp, Homo sapiens
  Payload ID: 2800
  Gene Symbol:
  Gene Name: CH507-9B2.5
  ENST ID: ENST00000617716
  CDS Start-End: 95-2854
aagtgcgtgctgtgggcggtgccgcgcggacccccgggaagtgtctctgtgggcggccgccgggttgagctgcggcacacgtgcgacagccgtgatgaagttcgcttaccggttttcaaatttgctgggtacggtgtaccggcgtgggaacctaaattttacctgcaatggaaattcagttatcagtcccgtgggcaatagagtcactgtatttgaccttaaaaacaacaaatctgacacgctgcccctggccactcggtacaacgtcaagtgcgtggggctgtccccggatggccgcctcgctatcatcgtcgatgaagggggcgatgcgctgctggtcagcctggtctgcaggtctgtgctgcaccacttccacttcaagggctctgtgcacagtgtgtccttctcccctgatggcaggaagtttgttgtcacaaagggtaacattgcccagatgtatcatgcccctgggaagaagcgggagttcaacgccttcgttctggacaagacctattttgggccctacgatgagaccacctgcatcgactggacggatgactccaggtgctttgtggttgggagcaaagacatgtccacctgggtgttcggagccgagcgctgggacaacctcatctactatgcactggggggacataaggatgccatcgtggcctgcttctttgaatccaacagcctggacctgtactcactcagccaggacggagtgctgtgcatgtggcagtgtgacacgccccccgagggcttgcggctgaagccccctgcgggctggaaagcagacctgttgcagcgggaggaggaagaggaggaggaggaggaccaggagggcgacagagagaccaccatccggggaaaagccactccggccgaggaggagaagacaggaaaagtgaagtactcacggctggccaagtacttcttcaataaagaaggggattttaacaacctgacagctgcagcatttcataagaagtctcacctcttggtcactggctttgcttctggaatcttccatcttcatgagctgccagagtttaacctcatccactccctgagcatctcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaacaccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgttttgtctggacacgaagggcccatcagtggtctgtgttttaacccaatgaagtccgtcctggccagtgcctcctgggacaagacggtgcgcctatgggacatgtttgacagctggaggaccaaggagacgctggccctgacctctgatgctctggctgtgacttttcgccctgatggtgcggagctggctgtggccacactgaactcacagatcaccttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctctggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgggcgctgctgggcggccaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 116875 - DNA, 712 bp, Homo sapiens
  Payload ID: 2800
  Gene Symbol:
  Gene Name: CH507-9B2.5
  ENST ID: ENST00000632537
  CDS Start-End: 1-240
gaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgtgatccgtgcagcactgagtaggtgcagcagagaccacagggcctgcggagctgaagacgcctgagctagacagaagacttggctggctcccggcgtcaagagaggacgacgcatgcgtggcgctgctgggcggccaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatcca

SEQ ID NO: 116876 - DNA, 3634 bp, Homo sapiens
  Payload ID: 2801
  Gene Symbol:
  Gene Name: CH507-9B2.9
  ENST ID: ENST00000623998
  CDS Start-End: 1-612
acattatacaacgtgaaggctgagatctttcccccttcgggaatggagtattgcagaacaggctccctctgctccctggaggttttgatcacgaggctctcagacctcttggaggtggataaagatgaagcactgactgaatctgatgagcatttttcgacaaagcttatgtatgaagttgtcgacaacagtagcaactgggcagtgtgtgggaaaagctgcggtgtcatctccatgccagtggctgctcgggccactcacagggtccacatggaagtgatgccgctcttcgccgggtatctccccctgcccgacgtcaggctgttcaagtacctcccccatcattctgcacactcctcccaactggacgctgacagctggatagaaaacgacagcctgtcagtagacaagcacggggacgaccagccggacagcagcagcctcaagagcaggggcagcgtgcattcggcctgcagcagcgagcacaaaggcctacccatgccccggctgcaggcactgccggccggccaggtcttcaactccagctcgggcacacaagtcctggtcatccccagccaagatgaccacgtcctggaagtcagtgtaacatgacaacgccagggtgaacacacgccacttcccagctaggagtgcactttatgggactgtgactggactcttccgttctggctccagccagaccttcagtggtcctgcctggccgtggggacatcagagagtgtcatcacgcagctggccagctgagttctgttgttgttttcatgccgcctgtgatctcagattcctgcttttctcaccccgtccccatgctggtgtccgacgccgcttactcagagccctggcctccctccccctacctcacacgctgctcatgaaagtttccacccacgctgtctccacggaacagcctccgtctgctggctcttcgtggaaggccatttgtctttcaggtagacactcagcagccctcacggtcttagtgacgtgtgtgcctttctggtcacacagctgcccagtttcctgatcggggtggatttgtgtcccctaaggggtaaaacagccgtttaccgcagatcctctcattgtgcttttctagaataacacccttctaggggaggcgggtgggggagggagggatcataaccccttctgtgccttgggatgccggagctgggggacctggaggcccatcagccggagccacgtgaaaggtactgaagaaagctgagacccggctgtgaggagcgcctcagcggtgaggtggtttagggataaatgtttctggaaccctgtggtcccccataatgttgatagaatatcatatgcactgggagttaaatatatttaatttaatgatcattatatatgtgggggttaatatgttgtttttctgtccctttaaagtctttacatgtaattgtagctgtataatcgttatttttcttttgcatcttaagtcttagaaattaagatattccatcgtgaggatgagagaggtcctcagtgtgtttttggtctggttgtagggaaggactcaagtcctggaatgtcctccactggtctactgagttgcagtcacactgttccaatggattatttgctttcggttgtaaatttaattgtacatatggttgatttattatttttaaaaatacagactaactgatgtaatgtttatgtataagttgcaccaaaaatcaaggacaaaaataagtgtgtttgtttttacaggtgtgaaagtcacagcttgtaaataagtgttgtatgtattaaaccttttccagttctccaaagcgatgtatttttgtacacttgaaatagagtactcttaatttactgggcaaatgtgcttggaattgaacttgacaagattagctcaagcagatagagtcgggtccagcagtgggtggccctcgtgtgaatccccgtggatgtgcaagttgtggagagaaggagcaccgggttcctgcccagcactgtgcttgcgggaggcggtggggcatgggaggaaggaggcacagaccggggaaatatgacagccgtcatttccagtattctctgtgttgtcttttagctcattcaataaataaaggtggtgtgatttttttttcctcctgtctttttcatttgtagaaactggagacgtgtaaagaagataaataattgtgtaattaaactttccagaaatttatcttcctcatgtgcagtttaacaaacttggtcaaactagttagcaaattagaacttcagaatctaatgatagtttagggtttctaaaataaggttttttattgtaaaaattgacgattgccctgcatttctaccaagtcctgtgaataaagagatgggagatttgattccgtcagaagagactgtaatccgtgtcgtcagcctgggagccttccccagtgtaatgtagctttctctcttaccttctggaagagggaatgtttcatttattactgtttgattttcttgtatctggttctactcccaggatgaaattatccaactacatatatatttagaggaagaaagtgaaggggaaatttaaaatgtttacggcgcttaattgcctggaaatgaaatgaaatcaaatttatcagtttttttccccctaattacccaaaagatcttttgcaaactatgttacatgaatgcttctgcctctttaagacaaagaagaatgtcacccaaaattgtcatttttttcttaatgttcatcataaaagtcctaaaagagtaactgtaattggatgtttattgtttttatctaaagtaaggtgtatgtgtttgagacaagctggttttgttgataaagagatgttaaataattgtgaagccagatatgcaatgtgtatctaaaaagcaaggaatttgcagccgttttacaaatatctgtggaacatgtaaatactgtcaaatggaaaataaaataagttataatttttgtgaatttcatgggatgtcctatgattggaaaaattataactcttctgattctaatgtggaaattgttgtatttaatctgaaaatgactttacctacaacagttccattgtcagcacagcctaggagggtcagattcctgtattaattactcttagtggagatgccagatatcccatacagaattagcagagaaaatacacacaggcttctattcaaattttctttagtgcttaaaattaagttttaaaatgaaatcagacactgcaggtttgtatataaaatgaaaagctatactactttttataaaagggcaaactgggctgatgtaaatgttttactttcaactgtgttctttaaaataaatcctacctggtttttaaattttatttttcatgaaaatgctcctttctctacatttattcatcctatatacatcaggctgtaagaccccccccagtcatcattaatacaatgtgttgggattctgtgactggaaaaggtgacaagttggtgactttgacactgcaggtattccattttcatggtttactatgaaaagtcatttttcatattatgtaatatattgttagattaaaaccattgtattaagactttaaaatgtaagcattgtaattctgaaaatacacattttaagaagaaa

SEQ ID NO: 116877 - DNA, 1204 bp, Homo sapiens
  Payload ID: 2802
  Gene Symbol: CHAC1
  Gene Name: ChaC glutathione-specific gamma-glutamylcyclotransferase 1
  Uniprot ID: Q9BUX1
  ENST ID: ENST00000444189
  CDS Start-End: 497-1156
gagacggaagtttacgacgcccagagcgctccttctggacgtgccctggactcgacttgggactgagtctgtgccgcctaggctggcagggactcggccagatgcactagcggcaaggctgggctgacaccgcctgggactcgctcgccgtacctccaaggggcccaggtcatgagggggcggctggggagacgcccgcccggtgcccgccctgggcccggcgggtgccccctgcccgccgcctgacgcaatccgaggcgcccttgctgcatgccggcgctggagaaacctcccctgccgttgcatcactcctgccaggtttgccacagaggtggagctgaaccaatcagcgggcgcgctgggcccgcggcgcggttaagtgagaagcagaatccgaagttgattggccaaaaggggatttgccccaccccaatcaccgcggcagctggccgcggtgggcgtggtctcccggcaagaaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagac

SEQ ID NO: 116878 - DNA, 1849 bp, Homo sapiens
  Payload ID: 2802
  Gene Symbol: CHAC1
  Gene Name: ChaC glutathione-specific gamma-glutamylcyclotransferase 1
  Uniprot ID: Q9BUX1
  ENST ID: ENST00000446533
  CDS Start-End: 310-1104
ggagacgcccgcccggtgcccgccctgggcccggcgggtgccccctgcccgccgcctgacgcaatccgaggcgcccttgctgcatgccggcgctggagaaacctcccctgccgttgcatcactcctgccaggtttgccacagaggtggagctgaaccaatcagcgggcgcgctgggcccgcggcgcggttaagtgagaagcagaatccgaagttgattggccaaaaggggatttgccccaccccaatcaccgcggcagctggccgcggtgggcgtggtctcccggcaagaaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctctttatctgtgc

SEQ ID NO: 116879 - DNA, 853 bp, Homo sapiens
  Payload ID: 2802
  Gene Symbol: CHAC1
  Gene Name: ChaC glutathione-specific gamma-glutamylcyclotransferase 1
  ENST ID: ENST00000487220
  CDS Start-End: 347-460
aaaatatttcttccctccctagcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatcc

SEQ ID NO: 116880 - DNA, 1498 bp, Homo sapiens
  Payload ID: 2802
  Gene Symbol: CHAC1
  Gene Name: ChaC glutathione-specific gamma-glutamylcyclotransferase 1
  ENST ID: ENST00000617961
  CDS Start-End: 92-760
caggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctcttta

SEQ ID NO: 116881 - DNA, 1560 bp, Homo sapiens
  Payload ID: 2802
  Gene Symbol: CHAC1
  Gene Name: ChaC glutathione-specific gamma-glutamylcyclotransferase 1
  Uniprot ID: Q9BUX1
  ENST ID: ENST00000617768
  CDS Start-End: 21-815
aaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatgcctggccgtgtggtgacgctccttgaagatcatgagggctgcacttggggcgtggcataccaagtgcaaggggagcaggtaagcaaggccctgaagtacctgaatgtgcgagaggcagtgcttggtggctacgataccaaggaggtcaccttctatccccaagatgctcctgaccaaccactgaaggcattggcctatgtggccaccccacagaaccctggttacctgggccctgcgcctgaagaggccattgccacgcagatcctggcctgccggggcttctccggccacaaccttgaatacttgctgcgtctggcagacttcatgcagctctgtgggcctcaggcgcaggacgagcacctggcagccatcgtggacgctgtgggcaccatgttgccctgcttctgccccaccgagcaggctctggcgctggtgtgaggggctgagcccctgcggggagtgctcatgtggacatcagggccagacacccactccagtgcacaagacagacttgcgaccgcttgagcccactgagcagatatggtgggtggctggaggcttctctttctcagtccctgcctgtctgccagcctgcagctctcctgcttgacactgacttactacttgaaactttatttattgcaccatgttggtgtggtgggcaggtggagggcctgccctggacacaggggccctgctgagcagtggccccatcctggaacttgaccagattccccccagtgctgctgctaaccccacaccacccaggcctccacctccccagggagtctccaagagcctcgatcctctgctcactcagcccagccatccatagccctgggaattccacctgccaaggatcccagcaggctggatgagggatagtagggcatgaggagaaggagccctgtaaggactgaggccccggccagcccttctcctccaccagttccccagagcagagctggagctgatgcctggacacagctgctgagcctggcctgggcctcttacccacttggttgttttcttgtccctctgtctgtctgtctatctacttgtctgtctgggccactcctgcctgtgtgttggtctattcctgggaagctcatcactacaggccctggcaaccttcccagtctgtcccatactgttacccataaaactatctctttatctgtgc

SEQ ID NO: 116882 - DNA, 1321 bp, Homo sapiens
  Payload ID: 2803
  Gene Symbol: CHAC2
  Gene Name: ChaC, cation transport regulator homolog 2 (E. coli)
  Uniprot ID: Q8WUX2
  ENST ID: ENST00000295304
  CDS Start-End: 96-650
gcgcggccggttactcgcttaccggaggcttcagtccccggcggcgcggcgacagctagggttcacggccactggggcagaggagccgcgagaagatgtgggtttttggttacgggtccctgatctggaaggtggatttcccctatcaggacaagctggtcggatacatcaccaactacagcaggcgcttctggcagggcagcacggaccaccgcggggtccccggcaagcctggaagagttgtgactcttgttgaagatcctgcgggatgtgtatggggtgttgcttacagattgccagtaggaaaggaagaagaagtaaaagcataccttgacttcagagaaaaaggaggctacagaaccacaacagtcattttttatccaaaagatcccacaacaaaaccattcagtgtattgctatatattggaacatgtgataatcctgattatcttggtcctgcacctctggaagacattgctgaacaaatttttaatgcagctggtccaagtggaagaaatacagaatatctttttgaacttgcaaattctattaggaaccttgtgccagaagaagcagatgagcatcttttcgctttggaaaaattagtaaaggaacgtttagaagggaaacagaacctcaattgcatataatttagtcttcagagaattaacttcagtgcacaatgacaatatgatttggaaatacgtttacttaaagatcttatttttaatgtagtgaggatattatttaaacttttattttaactggaaatgtcctgaaacacatatttaaaatattgggatacagtgaaagaaaaattcaaattttaataacataaagatttcctaactttatgttattgaacacttactcactagaagtgagttctttagaaaaatacagtgaaggactcagttcagtcttgtttttatcagagtgataatcatcctgtttcacatcccaatactattttgaaattctaaacaattaaaccaaaattccaataaatataaggttatgccttcaatatattcctatacaattctgtaaccatggtttaaaatacacaagcttaaaataacatgcttagaaatacacaataatatgaacagtatttcagccttaattgtgaatttccttgttattcaagtattaaatgaaatcttttgagtttttagccaaaaattggcatttttaaaatacgaaaatttccttggaattataatgtactgtacctcttcttttttaaataaaggcattttactatatggaaaataactcactaaagcataaattacattatacaaatcatgatcactaa

SEQ ID NO: 116883 - DNA, 2041 bp, Homo sapiens
  Payload ID: 2804
  Gene Symbol: CCT2
  Gene Name: chaperonin containing TCP1, subunit 2 (beta)
  Uniprot ID: P78371
  ENST ID: ENST00000299300
  CDS Start-End: 189-1796
agtgtgaaaggctgcgtttccggcccgtggggctccaatcaaaatgggacgcctgctggcggtaacgacaggccggggccccgccccccgaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 116884 - DNA, 1728 bp, Homo sapiens
  Payload ID: 2804
  Gene Symbol: CCT2
  Gene Name: chaperonin containing TCP1, subunit 2 (beta)
  ENST ID: ENST00000544368
  CDS Start-End: 63-1655
gtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattgggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaa

SEQ ID NO: 116885 - DNA, 2189 bp, Homo sapiens
  Payload ID: 2804
  Gene Symbol: CCT2
  Gene Name: chaperonin containing TCP1, subunit 2 (beta)
  Uniprot ID: P78371
  ENST ID: ENST00000543146
  CDS Start-End: 483-1949
gcgtgcggcctgcgccaggccagccggtggagctcaccacgagggggaggggtggaccgcaaagccagcgtctccttgtgcctaggtctttgcatagtcccggcagcccaggtccgcgcctcacccggagcgaagaaatttctagtgtgggacccgctccgccctccttctaggggcggagcctggagcgacggggtctgagccatcagagggtggaggggccgcagccttccgagggtggaagatggaggccgcgttccctcgcccgcccggcaggcgtcaccttgatggcctgcaacccctccctgcctcattcttagttcaagatcgtctttagtctcgctgcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaac

SEQ ID NO: 116886 - DNA, 1754 bp, Homo sapiens
  Payload ID: 2804
  Gene Symbol: CCT2
  Gene Name: chaperonin containing TCP1, subunit 2 (beta)
  ENST ID: ENST00000550010
  CDS Start-End: 51-1301
cgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggagttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaa

SEQ ID NO: 116887 - DNA, 2150 bp, Homo sapiens
  Payload ID: 2805
  Gene Symbol: CCT3
  Gene Name: chaperonin containing TCP1, subunit 3 (gamma)
  Uniprot ID: P49368
  ENST ID: ENST00000295688
  CDS Start-End: 282-1919
actgcgcaagcgcctgtgccctcccagtgccttcgtcgtgcgctctctgtctaacttgtctggccgttcttgcgtagggggcgggactaaggctgtcaattggtctgtttttgtgccgatcaatgagatgggtgcggtgattggcgactaccttgagagtagcgggttgaggtgtaagccctgaggaggcagcgttttctgggcttctgtctggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttga

SEQ ID NO: 116888 - DNA, 1885 bp, Homo sapiens
  Payload ID: 2805
  Gene Symbol: CCT3
  Gene Name: chaperonin containing TCP1, subunit 3 (gamma)
  ENST ID: ENST00000368258
  CDS Start-End: 80-202
gcttctgtctggttctctctctccagaaggttctgccggttcccccagctctgggtacccggctctgcatcgcgtcgccatgatgggccatcgtccagtgctcgtgctcaactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttg

SEQ ID NO: 116889 - DNA, 1815 bp, Homo sapiens
  Payload ID: 2805
  Gene Symbol: CCT3
  Gene Name: chaperonin containing TCP1, subunit 3 (gamma)
  Uniprot ID: P49368
  ENST ID: ENST00000368259
  CDS Start-End: 62-1585
ctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttg

SEQ ID NO: 116890 - DNA, 2048 bp, Homo sapiens
  Payload ID: 2805
  Gene Symbol: CCT3
  Gene Name: chaperonin containing TCP1, subunit 3 (gamma)
  ENST ID: ENST00000368262
  CDS Start-End: 64-228
ctctctccagaaggttctgccggttcccccagctctgggtacccggctctgcatcgcgtcgccatgatgggccatcgtccagtgctcgtgctcaagacggagtttcaccatgttgaccaggctggtctccaactgctgatgagctcaggtgatccgcccacctcggcctcccaaagtgctgagattacaggcgtgagccaccgcgcccggtcccttatttttttctgatgagcaccacctccattgtcttcctttggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaa

SEQ ID NO: 116891 - DNA, 593 bp, Homo sapiens
  Payload ID: 2805
  Gene Symbol: CCT3
  Gene Name: chaperonin containing TCP1, subunit 3 (gamma)
  ENST ID: ENST00000446905
  CDS Start-End: 28-593
gagaattgcttcctgagaaggtaatgaatgtatgaaggtgatctggaaggacaatctatgaattggacaagtgaagaaggaagaggagacattataagaagtgggaccaacatagaccgagcctggcagtgccagaacacaaagcgtgaatccggaagaaaagttcaatctggaaacatcaatgctgccaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaa

SEQ ID NO: 116892 - DNA, 842 bp, Homo sapiens
  Payload ID: 2805
  Gene Symbol: CCT3
  Gene Name: chaperonin containing TCP1, subunit 3 (gamma)
  ENST ID: ENST00000413555
  CDS Start-End: 14-842
gagaaggtaatgaatgtatgaaggtgatctggaaggacaatctatgaattggacaagtgaagaaggaagaggagacattataagaagtgggaccaacatagaccgagcctggcagtgccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagcc

SEQ ID NO: 116893 - DNA, 513 bp, Homo sapiens
  Payload ID: 2805
  Gene Symbol: CCT3
  Gene Name: chaperonin containing TCP1, subunit 3 (gamma)
  ENST ID: ENST00000415548
  CDS Start-End: 31-513
tctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgagtctcactctgtcaccatgctggagtgtggtggtgcgatcttggctcactgcaacctctgcctcccagcaggggaaatgctgtctgtagctgagcacttcctggagcagcagatgcacccaacagtggtgatcagtgcttaccgcaaggcattggatgatatgatcagcaccctaaag

SEQ ID NO: 116894 - DNA, 1858 bp, Homo sapiens
  Payload ID: 2805
  Gene Symbol: CCT3
  Gene Name: chaperonin containing TCP1, subunit 3 (gamma)
  ENST ID: ENST00000472765
  CDS Start-End: 322-1824
gtctggttctctctctccagaaggttctgccggttcccccagctctgggtacccggctctgcatcgcgtcgccatgatgggccatcgtccagtgctcgtgctcattaggtctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaacca

SEQ ID NO: 116895 - DNA, 748 bp, Homo sapiens
  Payload ID: 2805
  Gene Symbol: CCT3
  Gene Name: chaperonin containing TCP1, subunit 3 (gamma)
  ENST ID: ENST00000496684
  CDS Start-End: 46-748
gccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaacc

SEQ ID NO: 116896 - DNA, 581 bp, Homo sapiens
  Payload ID: 2805
  Gene Symbol: CCT3
  Gene Name: chaperonin containing TCP1, subunit 3 (gamma)
  ENST ID: ENST00000533194
  CDS Start-End: 149-581
gtaagccctgaggaggcagcgttttctgggcttctgtctggttctctctctccagaaggttctgccggttcccccagctctgggtacccggctctgcatcgcgtcgccatgatgggccatcgtccagtgctcgtgctcagccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatg

SEQ ID NO: 116897 - DNA, 583 bp, Homo sapiens
  Payload ID: 2805
  Gene Symbol: CCT3
  Gene Name: chaperonin containing TCP1, subunit 3 (gamma)
  ENST ID: ENST00000478640
  CDS Start-End: 122-583
agcgggttgaggtgtaagccctgaggaggcagcgttttctgggcttctgtctggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacatt

SEQ ID NO: 116898 - DNA, 2520 bp, Homo sapiens
  Payload ID: 2806
  Gene Symbol: CCT4
  Gene Name: chaperonin containing TCP1, subunit 4 (delta)
  Uniprot ID: P50991
  ENST ID: ENST00000394440
  CDS Start-End: 298-1917
gcgtaaaggttcccccggcgctcttcacccacagcgccccgggcgtacaatctcgccagcccggagcccaccgcacgcatcctcctcgcccggcgcgcagcggacagcctcctacgtcacgccagcgccgcgcggcaaggaaggcccccttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacatatatgtagcaaatcttacttaaacaaaagggtttcttaa

SEQ ID NO: 116899 - DNA, 2261 bp, Homo sapiens
  Payload ID: 2806
  Gene Symbol: CCT4
  Gene Name: chaperonin containing TCP1, subunit 4 (delta)
  Uniprot ID: P50991
  ENST ID: ENST00000544079
  CDS Start-End: 165-1694
ggcaaggaaggcccccttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacatata

SEQ ID NO: 116900 - DNA, 3675 bp, Homo sapiens
  Payload ID: 2807
  Gene Symbol: CCT5
  Gene Name: chaperonin containing TCP1, subunit 5 (epsilon)
  Uniprot ID: P48643
  ENST ID: ENST00000280326
  CDS Start-End: 421-2046
aaaaaaaaaaaaaaccggaaatgggtcctaccatcttctcggagccggagtgcgaagaaataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattgaaggggtttgggtggatttttttttctcaaaataagctgtagggactattttaacagcttaaacaggagctctcaagatgcactttcatattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccggccccaccctgaacacagctcatacacagaatcaggaccagcatgtgcagagctggccaccagcacaggcttagggcagttcagaacccacttgtttccctatcagagggacacagtgaagtggaggttaaagtaaattacaggaaataagggagaaatcttgcagttaccatgttcagatagagtgactgaaattaattgtacttactaaagtattaactagctaacagtgatgggccaagacgctccgagaactctaccgggattgtctgttctgacaacccagtgaggcagatacactttcttactgctcacatcttacaggtgagtactcataattggccagcatctcaccaccagcaagtagtagggccaggtcaatcccaggcagtctgaccccagagtggcccagctcatcccctactctgttatttgcttgttaatgattctctagattttctaaaataatgtttcttagcattgtgatgataaagctcatgatgaactttatcactagttatgccaccttaactagtcagatttcctagaattaggaaatggtgactcttgtctaaatttggttaagtgatgaatttgggttaccgtctcatgtgaacctggagattcaccagtcttaacttttgggtcattgtgttttctctacattcatgcattggatgttttgctaaataactcctgtggatttaggaatgtgtgctaatagcaatcttcctaattttcatgtttatatggaactatgcagttgagtattgaaagctttaaactgagtttatttacaaggactgagtctagcctacagagaacatacagcagccttctttggaccacagtcttatccgaggggtctgtggttgtatcagaagagccactaaaccaatccccctttccaaaattgaacctcacagacgttcctgttttttgtgattgagaaactggtcaatgaacaggaagacttagagatgtttcacaagcctttgatttttgtttcatttatttgtaataaacctcttccacgtgatgtcttttatttttcacgttcca

SEQ ID NO: 116901 - DNA, 762 bp, Homo sapiens
  Payload ID: 2807
  Gene Symbol: CCT5
  Gene Name: chaperonin containing TCP1, subunit 5 (epsilon)
  ENST ID: ENST00000503454
  CDS Start-End: 1-188
tcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaa

SEQ ID NO: 116902 - DNA, 1939 bp, Homo sapiens
  Payload ID: 2807
  Gene Symbol: CCT5
  Gene Name: chaperonin containing TCP1, subunit 5 (epsilon)
  Uniprot ID: P48643
  ENST ID: ENST00000506600
  CDS Start-End: 365-1711
gtgctccccggaaaggtcgagaatctccgtctccctgcggtctccggccgctcagcccgcttactgagctcgggagacgccggcgcctaatcctgggctcggaatgtgggggccagccaggctgggccgccagcgcccttcggagctgggtggggccgctcagtccggtcgcccgcgggagcaaagcgggaccgcctccccgcccggctcctccagcctgacggccgcgtgggactgcgctccagtgggagggcgccggggagatgctctgtcacctgtcggttaaggcgctgctgcttaacctttcgctggtccacccgcaacggcccttccgttttctttgtcactcgtaaagtctcatataatggcagcaaaggctgtagcaaatacaatgagaacatcacttggaccaaatgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaac

SEQ ID NO: 116903 - DNA, 582 bp, Homo sapiens
  Payload ID: 2807
  Gene Symbol: CCT5
  Gene Name: chaperonin containing TCP1, subunit 5 (epsilon)
  ENST ID: ENST00000511700
  CDS Start-End: 1-267
gtgcgcaagcttttgggccctcccgagaaagggaagtgcattctcgcttccgtagcggtctccgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacacta

SEQ ID NO: 116904 - DNA, 1933 bp, Homo sapiens
  Payload ID: 2807
  Gene Symbol: CCT5
  Gene Name: chaperonin containing TCP1, subunit 5 (epsilon)
  ENST ID: ENST00000503026
  CDS Start-End: 76-1638
aaaaaaccggaaatgggtcctaccatcttctcggagccggagtgcgaagaaataaagaaatagtgctttaagtcaatgaattcctccttgggacccactatcgagaaactatcagtgtctcatataatggcagcaaaggctgtagcaaatacaatgagaacatcacttggaccaaatgggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattg

SEQ ID NO: 116905 - DNA, 578 bp, Homo sapiens
  Payload ID: 2807
  Gene Symbol: CCT5
  Gene Name: chaperonin containing TCP1, subunit 5 (epsilon)
  ENST ID: ENST00000512975
  CDS Start-End: 23-157
aagtaattccggttgttgcaccatggcgtccatggggaccctcgccttcgatgaatatgggcgccctttcctcatcatcaaggatcaggaccgcaagtcccgtcttatgggacttgaggccctcaagggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggagga

SEQ ID NO: 116906 - DNA, 1728 bp, Homo sapiens
  Payload ID: 2807
  Gene Symbol: CCT5
  Gene Name: chaperonin containing TCP1, subunit 5 (epsilon)
  ENST ID: ENST00000515390
  CDS Start-End: 126-1586
ataagtcccgcgcgtcttgtgctgcgcgtgcgcaagcttttgggccctcccgagaaagggaagtgcattctcgcttccgtagcggtctccgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccat

SEQ ID NO: 116907 - DNA, 1997 bp, Homo sapiens
  Payload ID: 2807
  Gene Symbol: CCT5
  Gene Name: chaperonin containing TCP1, subunit 5 (epsilon)
  ENST ID: ENST00000515676
  CDS Start-End: 367-1878
atgtgctccccggaaaggtcgagaatctccgtctccctgcggtctccggccgctcagcccgcttactgagctcgggagacgccggcgcctaatcctgggctcggaatgtgggggccagccaggctgggccgccagcgcccttcggagctgggtggggccgctcagtccggtcgcccgcgggagcaaagcgggaccgcctccccgcccggctcctccagcctgacggccgcgtgggactgcgctccagtgggagggcgccggggagatgctctgtcacctgtcggttaaggcgctgctgcttaacctttcgctggtccacccgcaacggcccttccgttttctttgtcactcgtaaagtctcatataatggcagcaaaggctgtagcaaatacaatgagaacatcacttggaccaaatgggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataat

SEQ ID NO: 116908 - DNA, 135 bp, Homo sapiens
  Payload ID: 2807
  Gene Symbol: CCT5
  Gene Name: chaperonin containing TCP1, subunit 5 (epsilon)
  ENST ID: ENST00000625723
  CDS Start-End: 1-135
atggcgtccatggggaccctcgccttcgatgaatatgggcgccctttcctcatcatcaaggatcaggaccgcaagtcccgtcttatgggacttgaggccctcaagggtcaacagttgtcaccgacagatggctga

SEQ ID NO: 116909 - DNA, 2719 bp, Homo sapiens
  Payload ID: 2808
  Gene Symbol: CCT6A
  Gene Name: chaperonin containing TCP1, subunit 6A (zeta 1)
  Uniprot ID: P40227
  ENST ID: ENST00000275603
  CDS Start-End: 220-1815
caaggccgaggcgcgaagggtgggaccgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagttgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 116910 - DNA, 2529 bp, Homo sapiens
  Payload ID: 2808
  Gene Symbol: CCT6A
  Gene Name: chaperonin containing TCP1, subunit 6A (zeta 1)
  Uniprot ID: P40227
  ENST ID: ENST00000335503
  CDS Start-End: 165-1625
agcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagttgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 116911 - DNA, 1838 bp, Homo sapiens
  Payload ID: 2809
  Gene Symbol: CCT6B
  Gene Name: chaperonin containing TCP1, subunit 6B (zeta 2)
  Uniprot ID: Q92526
  ENST ID: ENST00000314144
  CDS Start-End: 117-1709
acttcctgtaagggcgatgattggccgaggctcaagagagcgtggcgtcgcattgccgtttttgctcagaatcgcgactaaggctttttttttttctccctctgaacggttaggctatggctgcgataaaggccgtcaactccaaggctgaggtggcgcgggcccgggcagctttggctgtcaatatatgcgccgcccgagggctgcaggatgtgctgcggaccaacttgggtcctaaaggcaccatgaaaatgcttgtttctggtgcaggtgacatcaaactcaccaaagatggcaatgtgctgctcgatgagatgcaaattcaacatccaacagcttccttgatagcaaaagtagcaacagctcaggatgacgtcacaggagatggtactacttcaaatgttctaattattggagagttattaaaacaagctgacctgtacatttctgagggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctggtttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttttgggtcttaa

SEQ ID NO: 116912 - DNA, 1680 bp, Homo sapiens
  Payload ID: 2809
  Gene Symbol: CCT6B
  Gene Name: chaperonin containing TCP1, subunit 6B (zeta 2)
  Uniprot ID: Q92526
  ENST ID: ENST00000421975
  CDS Start-End: 10-1491
ggttaggctatggctgcgataaaggccgtcaactccaaggctgaggtggcgcgggcccgggcagctttggctgtcaatatatgcgccgcccgagggctgcaggatgtgctgcggaccaacttgggtcctaaaggcaccatgaaaatgcttgtttctggtgcaggtgacatcaaactcaccaaagatggcaatgtgctgctcgatgagatgcaaattcaacatccaacagcttccttgatagcaaaagtagcaacagctcaggatgacgtcacaggagatggtactacttcaaatgttctaattattggagagttattaaaacaagctgacctgtacatttctgagggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaaagaggtgaactctggtttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttttgggtcttaatagtctcaaaaatatttcatcaaggtataaagaacacaataaatacttttacagtaaagg

SEQ ID NO: 116913 - DNA, 1639 bp, Homo sapiens
  Payload ID: 2809
  Gene Symbol: CCT6B
  Gene Name: chaperonin containing TCP1, subunit 6B (zeta 2)
  Uniprot ID: Q92526
  ENST ID: ENST00000436961
  CDS Start-End: 66-1523
attgccgtttttgctcagaatcgcgactaaggctttttttttttctccctctgaacggttaggctatggctgcgataaaggccgtcaactccaaggctgaggtggcgcgggcccgggcagctttggctgtcaatatatgcgccgcccgagggctgcaggatgtgctgcggaccaacttgggtcctaaaggcaccatgaaaatgcttgtttctggtgcaggtgacatcaaactcaccaaagatggcaatgtgctgctcgatgagatgggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctggtttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtc

SEQ ID NO: 116914 - DNA, 654 bp, Homo sapiens
  Payload ID: 2809
  Gene Symbol: CCT6B
  Gene Name: chaperonin containing TCP1, subunit 6B (zeta 2)
  ENST ID: ENST00000585073
  CDS Start-End: 271-654
cgcgccgctgtcggagagtggcggggacagtggggtcggcggcgtaggccgcgacccccggcgaggcagaaaggagcgctcctccaccgggtccgggacgcaggcgggaagtgatcaaggctccctgagtcccacccgagcgctcccggttcagcgcaggaggacgcacgccgggccaggggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctggtttcttttataagactgcagaagagaaagagaaattggtaaaagctgaaagaaaatttattgaagataga

SEQ ID NO: 116915 - DNA, 1916 bp, Homo sapiens
  Payload ID: 2810
  Gene Symbol: CCT7
  Gene Name: chaperonin containing TCP1, subunit 7 (eta)
  Uniprot ID: Q99832
  ENST ID: ENST00000258091
  CDS Start-End: 142-1773
agagtagcggaagtggtccgttctcttcctctcccggcccaagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttc

SEQ ID NO: 116916 - DNA, 1234 bp, Homo sapiens
  Payload ID: 2810
  Gene Symbol: CCT7
  Gene Name: chaperonin containing TCP1, subunit 7 (eta)
  Uniprot ID: Q99832
  ENST ID: ENST00000398422
  CDS Start-End: 72-1091
attgtgggttgctgggcggcccggtctcggagaagaggggagagtggcgggccgctgaataagcttccaaaatgatggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttc

SEQ ID NO: 116917 - DNA, 567 bp, Homo sapiens
  Payload ID: 2810
  Gene Symbol: CCT7
  Gene Name: chaperonin containing TCP1, subunit 7 (eta)
  ENST ID: ENST00000409924
  CDS Start-End: 71-322
ttgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcat

SEQ ID NO: 116918 - DNA, 593 bp, Homo sapiens
  Payload ID: 2810
  Gene Symbol: CCT7
  Gene Name: chaperonin containing TCP1, subunit 7 (eta)
  ENST ID: ENST00000399032
  CDS Start-End: 300-593
attgtgggttgctgggcggcccggtctcggagaagaggggagagtggcgggccgctgaataagcttccaaaatgatgcattgctcattcttgaagtcgtcttcatcttctgtgcagaggcagcatagtacagcagttgagagtaaggcctctggagctacactgaatgcctagcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgacc

SEQ ID NO: 116919 - DNA, 2031 bp, Homo sapiens
  Payload ID: 2810
  Gene Symbol: CCT7
  Gene Name: chaperonin containing TCP1, subunit 7 (eta)
  Uniprot ID: Q99832
  ENST ID: ENST00000539919
  CDS Start-End: 372-1871
atagagtagcggaagtggtccgttctcttcctctcccggcccaagcttctgggtatttctattgcgcgaggcattgtgggttgctgggcggcccggtctcggagaagaggggagagtggcgggccgctgaataagcttccaaaatgatgcattgctcattcttgaagtcgtcttcatcttctgtgcagaggcagcatagtacagcagttgagagtaaggcctctggagctacactgaatgcctagcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcagataactttgtaaatt

SEQ ID NO: 116920 - DNA, 1674 bp, Homo sapiens
  Payload ID: 2810
  Gene Symbol: CCT7
  Gene Name: chaperonin containing TCP1, subunit 7 (eta)
  Uniprot ID: Q99832
  ENST ID: ENST00000540468
  CDS Start-End: 144-1514
atagagtagcggaagtggtccgttctcttcctctcccggcccaagcttctgggtatttctattgcgcgaggcattgtgggttgctgggcggcccggtctcggagaagaggggagagtggcgggccgctgaataagcttccaaaatgatggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcagataactttgtaaatt

SEQ ID NO: 116921 - DNA, 249 bp, Homo sapiens
  Payload ID: 2810
  Gene Symbol: CCT7
  Gene Name: chaperonin containing TCP1, subunit 7 (eta)
  ENST ID: ENST00000626868
  CDS Start-End: 1-249
attctgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagagtttctgaagcaggtgaaaccctatgtggaggaaggtttacacccccagatcatcattcgagctttccgcacagccacccagctggtatg

SEQ ID NO: 116922 - DNA, 2005 bp, Homo sapiens
  Payload ID: 2811
  Gene Symbol: CCT8
  Gene Name: chaperonin containing TCP1, subunit 8 (theta)
  Uniprot ID: P50990
  ENST ID: ENST00000286788
  CDS Start-End: 208-1854
gatcggggatcgtcagcttggttctggccacagaggttgctcttctcgcgatgcttcagacctggcggcagggaaagggtgggctaattggagagccaggaagagcgtgaggcggccccacgctgctttcccagaaggctgtgcgtgctcctcgcttcctccgcggtcttccgagcggtcgcgtgaactgcttcctgcaggctggccatggcgcttcacgttcccaaggctccgggctttgcccagatgctcaaggagggagcgaaacacttttcaggattagaagaggctgtgtatagaaacatacaagcttgcaaggagcttgcccaaaccactcgtacagcatatggaccaaatggaatgaacaaaatggttatcaaccacttggagaagttgtttgtgacaaacgatgcagcaactattttaagagaactagaagtacagcatcctgctgcaaaaatgattgtaatggcttctcatatgcaagagcaagaagttggagatggcacaaactttgttctggtatttgctggagctctcctggaattagctgaagaacttctgaggattggcctgtcagtttcagaggtcatagaaggttatgaaatagcctgcagaaaagctcatgagattcttcctaatttggtatgttgttctgcaaaaaaccttcgagatattgatgaagtctcatctctacttcgtacctccataatgagtaaacaatatggtaatgaagtatttctggccaagcttattgctcaggcatgcgtatctatttttcctgattccggccatttcaatgttgataacatcagagtttgtaaaattctgggctctggtatcagttcctcttcagtattgcatggcatggtttttaagaaggaaaccgaaggtgatgtaacatctgtcaaagatgcaaaaatagcagtgtactcttgtccttttgatggcatgataacagaaactaagggaacagtgttgataaagactgctgaagaattgatgaattttagtaagggagaagaaaacctcatggatgcacaagtcaaagctattgctgatactggtgcaaatgtcgtagtaacaggtggcaaagtggcagacatggctcttcattatgcaaataaatataatatcatgttagtgaggctaaactcaaaatgggatctccgaagactttgtaaaactgttggtgctacagctcttcctagattgacacctcctgtccttgaagaaatgggacactgtgacagtgtttacctctcagaagttggagatactcaggtggtggtttttaagcatgaaaaggaagatggcgccatttctaccatagtacttcgaggctctacagacaatctgatggatgacatagaaagggcagtagacgatggtgttaatactttcaaagttcttacaagggataaacgtcttgtacccggaggtggagcaacagaaattgaattagccaaacagatcacatcatatggagagacatgtcctggacttgaacagtatgctattaagaagtttgctgaggcatttgaagctattccccgcgcactggcagaaaactctggagttaaggccaatgaagtaatctctaaactttatgcagtacatcaagaaggaaataaaaacgttggattagatattgaggctgaagtccctgctgtaaaggacatgctggaagctggtattctagatacttacctgggaaaatattgggctatcaaactcgctactaatgctgcagtcactgtacttagagtggatcagatcatcatggcaaaaccagctggtgggcccaagcctccaagtgggaagaaagactgggatgatgaccaaaatgattgaaattggcttaatttttactgtaggtgaaggctgtatttgtagtagtactcaagaatcacctgatgttttcttattctccttaaattaagagttattttgtgtttgtattcttggctggatgttataataaacatattgttactgtcaaagc

SEQ ID NO: 116923 - DNA, 556 bp, Homo sapiens
  Payload ID: 2811
  Gene Symbol: CCT8
  Gene Name: chaperonin containing TCP1, subunit 8 (theta)
  ENST ID: ENST00000432178
  CDS Start-End: 1-322
tgaggcatttgaagctattccccgcgcactggcagaaaactctggagttaaggccaatgaagtaatctctaaactttatgcagtacatcaagaaggaaataaaaacgttggattagatattgaggctgaagtccctgctgtaaaggacatgctggaagctggtattctagatacttacctgggaaaatattgggctatcaaactcgctactaatgctgcagtcactgtacttagagtggatcagatcatcatggcaaaaccagctggtgggcccaagcctccaagtgggaagaaagactgggatgatgaccaaaatgattgaaattggcttaatttttactgaaagtgctgccaacacctggactagatttccagtgtttttgtcacagctctggaattcctgactcaaggtgacttgtttcaatagcaattaataatttgttgaagacactcgacttagcaaagtacaaaaaaaatgcttagaaaatagataaactgacatacaaaattaagtcagttttcataaagcagattctattttgttaaaatcagtaag

SEQ ID NO: 116924 - DNA, 968 bp, Homo sapiens
  Payload ID: 2811
  Gene Symbol: CCT8
  Gene Name: chaperonin containing TCP1, subunit 8 (theta)
  ENST ID: ENST00000431234
  CDS Start-End: 1-968
cgggctttgcccagatgctcaaggagggagcgaaacacttttcaggattagaagaggctgtgtatagaaacatacaagcttgcaaggagcttgcccaaaccactcgtacagcatatggaccaaatggaatgaacaaaatggttatcaaccacttggagaagttgtttgtgacaaacgatgcagcaactattttaagagaactagaagtacagcatcctgctgcaaaaatgattgtaatggcttctcatatgcaagagcaagaagttggagatggcacaaactttgttctggtatttgctggagctctcctggaattagctgaagaacttctgaggattggcctgtcagtttcagaggtcatagaaggttatgaaatagcctgcagaaaagctcatgagattcttcctaatttggtatgttgttctgcaaaaaaccttcgagatattgatgaagtctcatctctacttcgtacctccataatgagtaaacaatatggtaatgaagtatttctggccaagcttattgctcaggcatgcgtatctatttttcctgattccggccatttcaatgttgataacatcagagtttgtaaaattctgggaacagtgttgataaagactgctgaagaattgatgaattttagtaagggagaagaaaacctcatggatgcacaagtcaaagctattgctgatactggtgcaaatgtcgtagtaacaggtggcaaagtggcagacatggctcttcattatgcaaataaatataatatcatgttagtgaggctaaactcaaaatgggatctccgaagactttgtaaaactgttggtgctacagctcttcctagattgacacctcctgtccttgaagaaatgggacactgtgacagtgtttacctctcagaagttggagatactcaggtggtggtttttaagcatgaaaaggaagatggcgccatttctaccatagtactt

SEQ ID NO: 116925 - DNA, 1927 bp, Homo sapiens
  Payload ID: 2811
  Gene Symbol: CCT8
  Gene Name: chaperonin containing TCP1, subunit 8 (theta)
  Uniprot ID: P50990
  ENST ID: ENST00000540844
  CDS Start-End: 347-1774
gatcggggatcgtcagcttggttctggccacagaggttgctcttctcgcgatgcttcagacctggcggcagggaaagggtgggctaattggagagccaggaagagcgtgaggcggccccacgctgctttcccagaaggctgtgcgtgctcctcgcttcctccgcggtcttccgagcggtcgcgtgaactgcttcctgcaggctggccatggcgcttcacgttcccaaggctccgggctttgcccagatgctcaaggagggagcgaaacacttttcaggattagaagaggctgtgtatagaaacatacaagcttgcaaggagcttgcccaaaccactcgtacagcatatggaccaaatggtacagcatcctgctgcaaaaatgattgtaatggcttctcatatgcaagagcaagaagttggagatggcacaaactttgttctggtatttgctggagctctcctggaattagctgaagaacttctgaggattggcctgtcagtttcagaggtcatagaaggttatgaaatagcctgcagaaaagctcatgagattcttcctaatttggtatgttgttctgcaaaaaaccttcgagatattgatgaagtctcatctctacttcgtacctccataatgagtaaacaatatggtaatgaagtatttctggccaagcttattgctcaggcatgcgtatctatttttcctgattccggccatttcaatgttgataacatcagagtttgtaaaattctgggctctggtatcagttcctcttcagtattgcatggcatggtttttaagaaggaaaccgaaggtgatgtaacatctgtcaaagatgcaaaaatagcagtgtactcttgtccttttgatggcatgataacagaaactaagggaacagtgttgataaagactgctgaagaattgatgaattttagtaagggagaagaaaacctcatggatgcacaagtcaaagctattgctgatactggtgcaaatgtcgtagtaacaggtggcaaagtggcagacatggctcttcattatgcaaataaatataatatcatgttagtgaggctaaactcaaaatgggatctccgaagactttgtaaaactgttggtgctacagctcttcctagattgacacctcctgtccttgaagaaatgggacactgtgacagtgtttacctctcagaagttggagatactcaggtggtggtttttaagcatgaaaaggaagatggcgccatttctaccatagtacttcgaggctctacagacaatctgatggatgacatagaaagggcagtagacgatggtgttaatactttcaaagttcttacaagggataaacgtcttgtacccggaggtggagcaacagaaattgaattagccaaacagatcacatcatatggagagacatgtcctggacttgaacagtatgctattaagaagtttgctgaggcatttgaagctattccccgcgcactggcagaaaactctggagttaaggccaatgaagtaatctctaaactttatgcagtacatcaagaaggaaataaaaacgttggattagatattgaggctgaagtccctgctgtaaaggacatgctggaagctggtattctagatacttacctgggaaaatattgggctatcaaactcgctactaatgctgcagtcactgtacttagagtggatcagatcatcatggcaaaaccagctggtgggcccaagcctccaagtgggaagaaagactgggatgatgaccaaaatgattgaaattggcttaatttttactgtaggtgaaggctgtatttgtagtagtactcaagaatcacctgatgttttcttattctccttaaattaagagttattttgtgtttgtattcttggctggatgttataataaacatattgttactgtcaaagcct

SEQ ID NO: 116926 - DNA, 1862 bp, Homo sapiens
  Payload ID: 2811
  Gene Symbol: CCT8
  Gene Name: chaperonin containing TCP1, subunit 8 (theta)
  Uniprot ID: P50990
  ENST ID: ENST00000626972
  CDS Start-End: 127-1716
acttctcttcttccgcgaccgggagaaggccgagggatcggcggcacgatcgacattgtacaccttgaaggtggacggatgtgaagccgcgcgttgtagggctgaagcttaccaaagaaaggaagaatgcacttttcaggattagaagaggctgtgtatagaaacatacaagcttgcaaggagcttgcccaaaccactcgtacagcatatggaccaaatggaatgaacaaaatggttatcaaccacttggagaagttgtttgtgacaaacgatgcagcaactattttaagagaactagaagtacagcatcctgctgcaaaaatgattgtaatggcttctcatatgcaagagcaagaagttggagatggcacaaactttgttctggtatttgctggagctctcctggaattagctgaagaacttctgaggattggcctgtcagtttcagaggtcatagaaggttatgaaatagcctgcagaaaagctcatgagattcttcctaatttggtatgttgttctgcaaaaaaccttcgagatattgatgaagtctcatctctacttcgtacctccataatgagtaaacaatatggtaatgaagtatttctggccaagcttattgctcaggcatgcgtatctatttttcctgattccggccatttcaatgttgataacatcagagtttgtaaaattctgggctctggtatcagttcctcttcagtattgcatggcatggtttttaagaaggaaaccgaaggtgatgtaacatctgtcaaagatgcaaaaatagcagtgtactcttgtccttttgatggcatgataacagaaactaagggaacagtgttgataaagactgctgaagaattgatgaattttagtaagggagaagaaaacctcatggatgcacaagtcaaagctattgctgatactggtgcaaatgtcgtagtaacaggtggcaaagtggcagacatggctcttcattatgcaaataaatataatatcatgttagtgaggctaaactcaaaatgggatctccgaagactttgtaaaactgttggtgctacagctcttcctagattgacacctcctgtccttgaagaaatgggacactgtgacagtgtttacctctcagaagttggagatactcaggtggtggtttttaagcatgaaaaggaagatggcgccatttctaccatagtacttcgaggctctacagacaatctgatggatgacatagaaagggcagtagacgatggtgttaatactttcaaagttcttacaagggataaacgtcttgtacccggaggtggagcaacagaaattgaattagccaaacagatcacatcatatggagagacatgtcctggacttgaacagtatgctattaagaagtttgctgaggcatttgaagctattccccgcgcactggcagaaaactctggagttaaggccaatgaagtaatctctaaactttatgcagtacatcaagaaggaaataaaaacgttggattagatattgaggctgaagtccctgctgtaaaggacatgctggaagctggtattctagatacttacctgggaaaatattgggctatcaaactcgctactaatgctgcagtcactgtacttagagtggatcagatcatcatggcaaaaccagctggtgggcccaagcctccaagtgggaagaaagactgggatgatgaccaaaatgattgaaattggcttaatttttactgtaggtgaaggctgtatttgtagtagtactcaagaatcacctgatgttttcttattctccttaaattaagagttattttgtgtttgtattcttggctggatgttataataaacatattgttactgtc

SEQ ID NO: 116927 - DNA, 2060 bp, Homo sapiens
  Payload ID: 2812
  Gene Symbol: CCT8L2
  Gene Name: chaperonin containing TCP1, subunit 8 (theta)-like 2
  Uniprot ID: Q96SF2
  ENST ID: ENST00000359963
  CDS Start-End: 261-1934
gttgagaggccccaagacccagttcctttacagaatcaaccctggggtggctttaggactgggctctttggagctcatccttggacccacagtggagtgctggtccgtgctgatgtcttcagataccaatcaatgggcatttggctccttgcttccactgacctcttgagtactttcaacgatcggtgtcaggagtgccccagctgctgtttctagagcatctctgcaacccacggtggcctctcctctctctgcgggccatggacagcacagtcccttcagccctggagctgccccagcggctggcactgaacccaagggagagcccgaggagtccagaagaggaggagccccacctgctgagcagcttggctgcagtccagaccctggccagtgtcatccggccttgctatggcccccacggccggcagaagttcctggtgaccatgaaaggagaaacagtgtgcacggggtgtgccactgccatcctcagggccctggagctggagcacccagcagcatggctcctccgggaagcaggacaaacccaggcagagaatagtggggacggcacagccttcgtggttctgctgacggaagccttgctggaacaggcagagcagctgctgaaggctggcctgcctcgcccgcagctccgggaggcctacgccacggccactgcagaggtcctggccacactgccctccctggccatccaatctctggggcctttggaagatccatcctgggccctccattctgtgatgaatacccacaccctgtcccccatggaccacttgaccaagctggtggcccacgcctgctgggctatcaaggaactagacggcagcttcaagcctgagcgtgttggggtgtgcgcgctgcccggggggacactggaggattcctgcctcctcccggggttagcaatatctgggaagctctgtgggcaaatggccacagtgttaagtggtgccagggtggctctctttgcttgcccctttggtcctgcccatccaaatgcaccagcaacggcccgtctttctagtcctgctgatctagctcaatttagtaaaggaagcgatcaattactagaaaagcaagtaggccagctagcagctgcaggaattaatgtggcagtggtgttgggggaggtcgacgaggagaccctcacactggcggacaagtatggcatcgtggtgattcaagctaggtcttggatggagatcatttacctgagtgaggtgttggacacacctctgctgcctcgtctgctccctccccagaggccaggcaagtgccagagggtttacaggcaggagctgggagatggtttggctgtggtatttgaatgggaatgtacaggcacacctgccctcactgtggttctcaggggagccaccacccaggggctgcggagtgcagagcaggccgtctaccacggcattgatgcctatttccagctatgtcaagatcccagactgattccaggagctggggccacagaaatggctttggcaaaaatgctttctgataaaggaagcagattggaagggcccagtgggcctgcattcctagcatttgcctgggccctgaagtatcttcctaaaactttggcagagaatgcaggcttagctgtctcagacgtgatggcagaaatgagtggagtgcaccaaggtgggaacctcctaatgggtgtgggaactgaagggataataaatgtggcccaggaaggggtgtgggacaccctaatagtcaaagcccaaggatttcgagcagtggctgaggtggtgctacagctcgtgactgtagatgaaatcgtagtggccaagaaaagtcccacacatcaggagatctggaatcctgactctaagaagacaaagaaacacccacctcctgtggaaacaaaaaaaatccttggattgaataactagtgataccctcaataaaacagggattgccaagaagggaacaatcaccccaaaaatgaatgtttgcctttattccgtgtttggtacttgattcactttctttaaataaaaacatgaaggaacataaaa

SEQ ID NO: 116928 - DNA, 635 bp, Homo sapiens
  Payload ID: 2813
  Gene Symbol: CLC
  Gene Name: Charcot-Leyden crystal galectin
  Uniprot ID: Q05315
  ENST ID: ENST00000221804
  CDS Start-End: 77-505
atttaaattctgcagctcagagattcacacagaagtctggacacaattcagaagagccacccagaaggagacaacaatgtccctgctacccgtgccatacacagaggctgcctctttgtctactggttctactgtgacaatcaaagggcgaccacttgcctgtttcttgaatgaaccatatctgcaggtggatttccacactgagatgaaggaggaatcagacattgtcttccatttccaagtgtgctttggtcgtcgtgtggtcatgaacagccgtgagtatggggcctggaagcagcaggtggaatccaagaatatgccctttcaggatggccaagaatttgaactgagcatctcagtgctgccagataagtaccaggtaatggtcaatggccaatcctcttacacctttgaccatagaatcaagcctgaggctgtgaagatggtgcaagtgtggagagatatctccctgaccaaatttaatgtcagctatttaaagagataaccagacttcatgttgccaaggaatccctgtctctacgtgaacttgggattccaaagccagctaacagcatgatcttttctcacttcaatccttactcctgctcattaaaacttaatcaaacttcacagaa

SEQ ID NO: 116929 - DNA, 2483 bp, Homo sapiens
  Payload ID: 2814
  Gene Symbol: CHMP1A
  Gene Name: charged multivesicular body protein 1A
  Uniprot ID: Q9HD42
  ENST ID: ENST00000397901
  CDS Start-End: 258-848
agcgactcacaaaaggtcctcgcgccagcggcgtgcgtcaccatggcgaccgcgcgccgcgcagccgcgccccgcccctctggcgggaccggccaccatcctctcgcgagagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaacttt

SEQ ID NO: 116930 - DNA, 2295 bp, Homo sapiens
  Payload ID: 2814
  Gene Symbol: CHMP1A
  Gene Name: charged multivesicular body protein 1A
  ENST ID: ENST00000535997
  CDS Start-End: 294-692
cggcgaccccggaagtccccgccgggtgcagcttggtcggttcgatcgccgccgggacctgacaccgcccggagttggcgtcccttctccctctccgagtgctgctcctgtcattgtggccatggacgttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgt

SEQ ID NO: 116931 - DNA, 1003 bp, Homo sapiens
  Payload ID: 2814
  Gene Symbol: CHMP1A
  Gene Name: charged multivesicular body protein 1A
  ENST ID: ENST00000549328
  CDS Start-End: 134-679
ccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtatgtggcccctacccttggggctgtggcctggggacaaggagcgtgtgtgggcagctcatcgggaggggtggctcacaggctgacgtgctgtctctgcatacctgtggttgctccctgacgtcaccaagcatcctctgtgctgggtccctgccaggaccctgacaggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcag

SEQ ID NO: 116932 - DNA, 803 bp, Homo sapiens
  Payload ID: 2814
  Gene Symbol: CHMP1A
  Gene Name: charged multivesicular body protein 1A
  ENST ID: ENST00000550102
  CDS Start-End: 63-626
tgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgg

SEQ ID NO: 116933 - DNA, 3054 bp, Homo sapiens
  Payload ID: 2815
  Gene Symbol: CHMP1B
  Gene Name: charged multivesicular body protein 1B
  Uniprot ID: Q7LBR1
  ENST ID: ENST00000526991
  CDS Start-End: 117-716
gaaacaggaagtgggaccaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctaggactgtgtgtgtgtaggttttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaagtaaagaggtaggactggaaggaaggagaaagcttgagtctttaaggctagagcccagctgtgctgcctgccatcttctcaggaatggcagtgcgtattttctggctgaaaagtaaagcatgtatccaccgctttctcatagcctcgaaacatggagaaaagcaacttgcttttgccttggcaagcatgctaacctaagttaattcaagttttttttaacttaccctttccttcactggaagatttttccataagagaattccattgtttcagaaaataattataggggcccttccaagttctttgaaagattcataaccaactattcactattataacatgtttcccagtgtaaatgagtaaggaaaaaaaaagtgtaacaggtgcgtgcagatgaggagtgaccctcatatttaagttattttatatttgactggacattgttcagaagtgtgctttaagggacacttgttagttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcccaaagtgctgggattacaggcatgagccactgcacctggccttaacccctctttagattggaaaaaataattacaactttaaaaatagcttagtgttgaaccctttggtaaactaaagacccttttataatgcacatattcccaacaaaattaatatattttgtgagattaaacaatgcttgtatatgcttgaactttcttaaaatatgtccatgtcatactattatgaatgtacatttttatgagtcataaatattattttcaaaagcactacaggcccatgaattacttcctcacttttgcagttgattactgaaatgtaaatcacaagaatttgtcaattaaatcattttaaactgcatgtta

SEQ ID NO: 116934 - DNA, 913 bp, Homo sapiens
  Payload ID: 2816
  Gene Symbol: CHMP2A
  Gene Name: charged multivesicular body protein 2A
  Uniprot ID: O43633
  ENST ID: ENST00000312547
  CDS Start-End: 162-830
atgttacgtcacgtcgtttaatccggaaacggcggcggcggcgacaggaccgaggggccttagttggtgggcaagtcggggatcccagaaagagaagcgtgacccggaagcggaaacgggtgtccgtcccagctccggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 116935 - DNA, 1178 bp, Homo sapiens
  Payload ID: 2816
  Gene Symbol: CHMP2A
  Gene Name: charged multivesicular body protein 2A
  Uniprot ID: O43633
  ENST ID: ENST00000600118
  CDS Start-End: 427-1095
atcagaacccccacaattgctctgtcctcggtgcccacagtctccaaaacaccagtgcaccggcccgcgtcatcccccgctctcagtcgtatcaaggactccagggcctcacccatagttctggagagggaagctgaacttgcaagccataacttcttttggggcatggcgatgaaggaggggctcgggccagcacttggataattttcaggtctacctgtccccctttatgtgtccccgggacaatcccagtgttctcagctgctcccttttggctcctcattcctgcctccagtctccgttagccccttcccatttggcaaggctcccgtgaccctgttctgcttcttgccctcctgggccccatgccctacaactgggcctcactcacatctgtctcaggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 116936 - DNA, 509 bp, Homo sapiens
  Payload ID: 2816
  Gene Symbol: CHMP2A
  Gene Name: charged multivesicular body protein 2A
  ENST ID: ENST00000597848
  CDS Start-End: 343-509
ccggtgagtggcccctgctggaccgtggatcccgggcgggcgtgcgggcggcagcgtacgaggccttctactcgcccgggtgtccggtgcctcgcttctccctgggaccctgtcgtcaacatcgaggtctccaacaccaccttgctttggtgccgggcccactgactgtcctcggtgtatagtgcgaccgaatctccatcatcccgtcctcagtgtacaggatgccccagcgcccccaaccgtctccctcagcattcagggtccccaaatcctaatgccttgtcctgagcttcacagccccacattcacctgttcttggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagat

SEQ ID NO: 116937 - DNA, 687 bp, Homo sapiens
  Payload ID: 2816
  Gene Symbol: CHMP2A
  Gene Name: charged multivesicular body protein 2A
  ENST ID: ENST00000596708
  CDS Start-End: 209-687
cccgggcgggcgtgcgggcggcagcgtacgaggccttctactcgcccgggtgtccggtgcctcgcttctccctgggaccctgtcgtcaacatcgaggtctccaacaccaccttgctttggtgccgggcccactgactgtcctcggtgtatagtgcgaccgaatctccatcatcccgtcctcagtgcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagag

SEQ ID NO: 116938 - DNA, 766 bp, Homo sapiens
  Payload ID: 2816
  Gene Symbol: CHMP2A
  Gene Name: charged multivesicular body protein 2A
  ENST ID: ENST00000600006
  CDS Start-End: 1-683
aggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgagtgagtgctccaaatcctggaccccatttcccacccaaggcccagccacagctccaagccctccctttccctgcattactcccctccgctgcctgaccccacctgctcaaacccccactttctctgcagacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 116939 - DNA, 885 bp, Homo sapiens
  Payload ID: 2816
  Gene Symbol: CHMP2A
  Gene Name: charged multivesicular body protein 2A
  Uniprot ID: O43633
  ENST ID: ENST00000601220
  CDS Start-End: 134-802
ctggaccgtggatcccgggcgggcgtgcgggcggcagcgtacgaggccttctactcgcccgggtgtccggtgcctcgcttctccctgggaccctgtcgtcaacatcgaggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 116940 - DNA, 2557 bp, Homo sapiens
  Payload ID: 2817
  Gene Symbol: CHMP2B
  Gene Name: charged multivesicular body protein 2B
  Uniprot ID: Q9UQN3
  ENST ID: ENST00000263780
  CDS Start-End: 239-880
agaagtgacttctccaaaaagtgtgttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctactacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagtatatcgttaattctgtatctgttgcttgtcttttgtaagtgattatgtgttatgaccataggtggttacagctgccaaattatttttaaatggtcaaaaagaagagtgctatttaaacatctgtcttaaacaaaaactgtcataacttttcttttttctttttccattaggagaacattctagttggtaaatttcaaaatgtgcttgacacctgccttaaatagcacagacctattgtgcacatctttaaattatttcagctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatgacttgtccctttgatgtcactactgtgaattgaatataattagtaaaaatagacgatgaataaataacactttatagtaagaaaacaatatattttggccatctaaaaatgagaattataattatatgaattataatttaaactgtttaattttgtttaatgtgtatattgaatcttccaaattgaagccattattctcaattaagtactacaactatgacaatgcttgacctacatttctaaaataaaaattcacattttttgataaataaactacagttttaccagaaattactatctaaatgtgtattagcagtattttttaaggtgaaattgccttggtatctaatgaatgtgtagacagggagataaaatgaaggattgccagactagttagaatagaatttaggattaggttagttttgaaaaatgatgttgtaatatatgggttctaacacatcctaccataaaaactggaggagatatgtgtaacctggttaatttgggatggtggacattttgggctaatactgacaaaatacatcttaggactagtatacatgtgacacggattgctaggaggaatgaaaaactaaactgtatagtttatattccgtaaaccattttataatgttcaaagattaggttttgttattgatagtattaaatacacagtttctcttaacagtgatgggtgaaaacattttaccggattatggaatgtttaccagaacatgttttgattcttgaatgtacataataatgccatctaacttatttacgttcttgtttacatgtgggagcttttgttttcaaaaattattttgttaaaaaatctcaataaagatttattattgttgttcttttctta

SEQ ID NO: 116941 - DNA, 1175 bp, Homo sapiens
  Payload ID: 2817
  Gene Symbol: CHMP2B
  Gene Name: charged multivesicular body protein 2B
  ENST ID: ENST00000494980
  CDS Start-End: 222-773
aaagtgtgttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagtatatcgttaattctgta

SEQ ID NO: 116942 - DNA, 2528 bp, Homo sapiens
  Payload ID: 2817
  Gene Symbol: CHMP2B
  Gene Name: charged multivesicular body protein 2B
  Uniprot ID: Q9UQN3
  ENST ID: ENST00000471660
  CDS Start-End: 284-802
cgcaggcgccgcctagaagtgacttctccaaaaagtgtgttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctactacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagtatatcgttaattctgtatctgttgcttgtcttttgtaagtgattatgtgttatgaccataggtggttacagctgccaaattatttttaaatggtcaaaaagaagagtgctatttaaacatctgtcttaaacaaaaactgtcataacttttcttttttctttttccattaggagaacattctagttggtaaatttcaaaatgtgcttgacacctgccttaaatagcacagacctattgtgcacatctttaaattatttcagctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatgacttgtccctttgatgtcactactgtgaattgaatataattagtaaaaatagacgatgaataaataacactttatagtaagaaaacaatatattttggccatctaaaaatgagaattataattatatgaattataatttaaactgtttaattttgtttaatgtgtatattgaatcttccaaattgaagccattattctcaattaagtactacaactatgacaatgcttgacctacatttctaaaataaaaattcacattttttgataaataaactacagttttaccagaaattactatctaaatgtgtattagcagtattttttaaggtgaaattgccttggtatctaatgaatgtgtagacagggagataaaatgaaggattgccagactagttagaatagaatttaggattaggttagttttgaaaaatgatgttgtaatatatgggttctaacacatcctaccataaaaactggaggagatatgtgtaacctggttaatttgggatggtggacattttgggctaatactgacaaaatacatcttaggactagtatacatgtgacacggattgctaggaggaatgaaaaactaaactgtatagtttatattccgtaaaccattttataatgttcaaagattaggttttgttattgatagtattaaatacacagtttctcttaacagtgatgggtgaaaacattttaccggattatggaatgtttaccagaacatgttttgattcttgaatgtacataataatgccatctaacttatttacgttcttgtttacatgtgggagcttttgttttcaaaaattattttgttaaaaaatctcaataaagatttattattgttgttcttttcttaccttttttgctctttttggttcctgctaaaattaaaaattttatgcata

SEQ ID NO: 116943 - DNA, 836 bp, Homo sapiens
  Payload ID: 2817
  Gene Symbol: CHMP2B
  Gene Name: charged multivesicular body protein 2B
  ENST ID: ENST00000472024
  CDS Start-End: 298-836
gttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatgacagagtttcgctgttgttgcccaggctggagtgctggagtgcaatggcatgatctcggctcaacgcaaccatcacctcccagattcaagcgattcttctacctcagcctaccgagtagctcggattacagatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctactacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaa

SEQ ID NO: 116944 - DNA, 3171 bp, Homo sapiens
  Payload ID: 2818
  Gene Symbol: CHMP3
  Gene Name: charged multivesicular body protein 3
  Uniprot ID: Q9Y3E7
  ENST ID: ENST00000263856
  CDS Start-End: 130-798
tgccgccgctccctactctgggggttgggactacctccttttccgcgggccccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcat

SEQ ID NO: 116945 - DNA, 1099 bp, Homo sapiens
  Payload ID: 2818
  Gene Symbol: CHMP3
  Gene Name: charged multivesicular body protein 3
  Uniprot ID: Q9Y3E7
  ENST ID: ENST00000409225
  CDS Start-End: 269-739
agtgccgccgctccctactctgggggttgggactacctccttttccgcgggccccgcccaggcggctgcccgtgacctgcctgggcgcggggaactgaaagccggaaggggcaagacgggttcagttcgtcatggggctgtttggaaagacccaggagaagccgcccaaagaactgatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttgg

SEQ ID NO: 116946 - DNA, 1851 bp, Homo sapiens
  Payload ID: 2818
  Gene Symbol: CHMP3
  Gene Name: charged multivesicular body protein 3
  Uniprot ID: Q9Y3E7
  ENST ID: ENST00000409727
  CDS Start-End: 27-575
aaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctcc

SEQ ID NO: 116947 - DNA, 1393 bp, Homo sapiens
  Payload ID: 2819
  Gene Symbol: CHMP4A
  Gene Name: charged multivesicular body protein 4A
  Uniprot ID: Q9BY43
  ENST ID: ENST00000347519
  CDS Start-End: 302-1099
atgtgagacattagactgcatcaggtttgccatctaaacttagggcaaccccaagtgcttgaacctataccaccccactttcctgagctctgtaaagagcatgaagttttcccactgaccccatacactgaggtgccatcacactgcacatttccttccggagaacaagcacgtactcaggtggagatagaactgtctttttacttaatagaaaatgatgtggcagctttaagaggagcgcgtcggtctggggctggtggcttgggtcacgtgacaccggtggtctcgtttgcgcctcttgatgtcgcggcggcgccctgaggacggattgggcaaggctggtccctgtgtgatgagacatcaccctcccaggagcaaggcggaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagatggaatcctagtgtctatactgccttgtctacccctg

SEQ ID NO: 116948 - DNA, 733 bp, Homo sapiens
  Payload ID: 2819
  Gene Symbol: CHMP4A
  Gene Name: charged multivesicular body protein 4A
  ENST ID: ENST00000533011
  CDS Start-End: 94-733
acgcgcctgtagtcccagctactgggggaggctgagacaggtgaatcgcttgaacccaggaggcggaggttgtagtgagccaagattgcaccaatgcactccagccttggtgacagagggagactccattctcaaaaaaaaaaaaaaaaattagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccag

SEQ ID NO: 116949 - DNA, 1266 bp, Homo sapiens
  Payload ID: 2819
  Gene Symbol: CHMP4A
  Gene Name: charged multivesicular body protein 4A
  ENST ID: ENST00000533523
  CDS Start-End: 263-763
ttagggcaaccccaagtgcttgaacctataccaccccactttcctgagctctgtaaagagcatgaagttttcccactgaccccatacactgaggtgccatcacactgcacatttccttccggagaacaagcacgtactcaggtggagatagaactgtctttttacttaatagaaaatgatgtggcagctttaagaggagcgcgtcggtctggggctggtggcttgggtcacgtgacaccggtggtctcgtttgcgcctcttgatgtcgcggcggcgccctgaggacggattgggcaaggctggtccctgtgtgatgagacatcaccctcccaggagcaaggcggaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatgtggggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggc

SEQ ID NO: 116950 - DNA, 370 bp, Homo sapiens
  Payload ID: 2819
  Gene Symbol: CHMP4A
  Gene Name: charged multivesicular body protein 4A
  ENST ID: ENST00000534106
  CDS Start-End: 1-185
gtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagtttcagcgtgaggccattgagaatgccactaccaatgcagaagtccttcgtaccatggagcttgctgcccaaagcatgaagaaggcctaccaggacatgtggggacattgacaaggtagatgaactgatgactgacatcacggaacaacaggaggtggcccagcagatctcagatgccatttctcggcctatgggc

SEQ ID NO: 116951 - DNA, 967 bp, Homo sapiens
  Payload ID: 2819
  Gene Symbol: CHMP4A
  Gene Name: charged multivesicular body protein 4A
  ENST ID: ENST00000530996
  CDS Start-End: 361-714
cggaagtctggaggacgctgaggggcggaggcgggagaggcgagctcgcgatgagtggtctcggcaggctcttcgggaaggaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactggg

SEQ ID NO: 116952 - DNA, 735 bp, Homo sapiens
  Payload ID: 2819
  Gene Symbol: CHMP4A
  Gene Name: charged multivesicular body protein 4A
  Uniprot ID: Q9BY43
  ENST ID: ENST00000609024
  CDS Start-End: 50-718
ggaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtct

SEQ ID NO: 116953 - DNA, 1646 bp, Homo sapiens
  Payload ID: 2820
  Gene Symbol: CHMP4B
  Gene Name: charged multivesicular body protein 4B
  Uniprot ID: Q9H444
  ENST ID: ENST00000217402
  CDS Start-End: 166-840
ggtggcgcggccgggcccagctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttcata

SEQ ID NO: 116954 - DNA, 1866 bp, Homo sapiens
  Payload ID: 2821
  Gene Symbol: CHMP4C
  Gene Name: charged multivesicular body protein 4C
  Uniprot ID: Q96CF2
  ENST ID: ENST00000297265
  CDS Start-End: 194-895
ggggccgaactggcagccaggaaatgccctggagtgtgtgtcacctgtccaggacgacttgttgattcccaggagggccgcctttccggtctgggtccccgagaggactgccttgctcacctgtcccctcggcgcggccccggggagctcccgagaggcccccgggatcgctggccctccgaactccacagcaatgagcaagttgggcaagttctttaaagggggcggctcttctaagagccgagccgctcccagtccccaggaggccctggtccgacttcgggagactgaggagatgctgggcaagaaacaagagtacctggaaaatcgaatccagagagaaatcgccctggccaagaagcacggcacgcagaataagcgagctgcattacaggcactaaagagaaagaagaggttcgagaaacagctcactcagattgatggcacactttctaccattgagttccagagagaagccctggagaactcacacaccaacactgaggtgttgaggaacatgggctttgcagcaaaagcgatgaaatctgttcatgaaaacatggatctgaacaaaatagatgatttgatgcaagagatcacagagcaacaggatatcgcccaagaaatctcagaagcattttctcaacgggttggctttggtgatgactttgatgaggatgagttgatggcagaacttgaagaattggaacaggaggaattaaataagaagatgacaaatatccgccttccaaatgtgccttcctcttctctcccagcacagccaaatagaaaaccaggcatgtcgtccactgcacgtcgatcccgagcagcatcttcccagagggcagaagaagaggatgatgatatcaaacaattggcagcttgggctacctaaactaaaacacatttttgatacctaaattaatgagctatagataaaatataaaaaatgtttttaccaagttcagaagttaacaaagactctgctttataattatattgaatgaataattgtgttttaagcctcctaagtaaaagtaaaaaaggagtcatgtgcatacatagaatcagtgatggaggccaggcacggtatctcatgcctataatcccagcactttgggaggctgaggcagttgagaccaggagttcgagtccagcctgaccaacatgaagaaaccctgtctgtactaaaaatacaaaaattagccggacatggtggcaggcacctgtaatcccagctacttgggaggctgagtcaggagaatcgcttgagcccaggagatggaggttgcagtgagccaagatcatgccactgcactccagactgggcaacagagggagactccgtctcaaaaactaaaaaaaaaaaatacatttagtatagcggggggtgggggggagaaataatgttatttcctatgcgaatgacgtgtatccctgtacccatggtaaatgtaaatatactgtgtctcttttgggagagccttttagtagaggagtcttatatgagtctctacataagtagtttcacttgagttttgcagtttgaaatcttaaaggagctttaattgacatttattataccaattaagcttggaatggggcaatggatgcatttcccaaaacgtgtgaaagcactaacagcttatattgctgaatgagaatctcctgggtgtaatttagccacttagggaactgcgtgaacactcccaggccattatgatgctgttacagcttcagtgtataaatgcatgagtattctttctgttctgttttgtgctctcttgtacatttatttaccctttacagaatatttcttgtaaatacataaaaatattggcaattaaaagtacatcttgaataaaa

SEQ ID NO: 116955 - DNA, 1477 bp, Homo sapiens
  Payload ID: 2822
  Gene Symbol: CHMP5
  Gene Name: charged multivesicular body protein 5
  Uniprot ID: Q9NZZ3
  ENST ID: ENST00000223500
  CDS Start-End: 138-797
aatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaaggatataattttaataatatcacttcagc

SEQ ID NO: 116956 - DNA, 1957 bp, Homo sapiens
  Payload ID: 2822
  Gene Symbol: CHMP5
  Gene Name: charged multivesicular body protein 5
  Uniprot ID: Q9NZZ3
  ENST ID: ENST00000419016
  CDS Start-End: 201-716
ctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaaggatataattttaataatatcacttcagcttaaaacctctactgcggaaaccaaatttaatagaattttaatgtcatttcagcctataactccactacagaaaccaaattaaccagtagcattgtgaggaaagagcaaggaacaatctgggcttgggccctgggtctaccatttactaactactgagtagtctattcaacctctctaaccttctgtttccttattagtaaaatcatgcttaactcacagagcttttgtgaggaataattgaggtaatggtcataagtaccttgttaactgcaaggggctattcttatatgagggattgttaacaataaaaaagaaactgcttcattcttttcttggaaggtgcctggagtactacagcaagttcaaactcctgcccaatttcagggtctttaatgatcctgtcctcccttcctcattcaacttgttgccaacagcatggcccctccagcctagctgggtgcctcacagtgctatgtgcacctgactctcatgtgtctgcagatcaaaccaataaacatttaggaacacc

SEQ ID NO: 116957 - DNA, 1664 bp, Homo sapiens
  Payload ID: 2823
  Gene Symbol: CHMP6
  Gene Name: charged multivesicular body protein 6
  Uniprot ID: Q96FZ7
  ENST ID: ENST00000325167
  CDS Start-End: 79-684
aggacccgagctacggtggccgcggggcggcggtggcgattggacttggtgggtcccgggccaggggcgggcgccgccatgggtaacctgttcggccgcaagaagcagagccgcgtcacggagcaggacaaggccatcctgcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccagaaaacgtccctgtcaaggccaggcccaggcaggcggagctggtggcagcttcgtaacgtggcctcgtcttgtgggactcacggggatgccccagggactgtggcccacagagagtttgggtcacggccagcccctgaccgggttccctggagcccagtgcgcacggtgctgagcagagctgcagccacgcaggcgcattgcaggaggactccagagcgtctcctggagaccttgagcctgaacgcactcaggcgccactggcctgctctcagtccggattaactctcgaccgagcccagcttctgccggttgtgggctcccccggtggccgaggcccaggcccaacgcctctggtgctgttcccctgcagtcccagccccgcgtggctcgcgctcgtctgtgaggaagacacctccagaccttggggtccccgcgcttcctcttgctcctcgctgctcccattagctggtgcaggcttccgttaaggggtccctcccttggcctggcttcccggcgcacctcagcttccctgctggtggggggatccccaggagaccagcatgtgctgaacctctctgtgcctctgcctccgcaccctagacacccacctccagtttgaaggtggcgggccaggggctttcttgctgaattgacgactccgagagccctgactcccgccttgccactcacggctctgtccactagggctcagccctgctgagaaaggacctccgatgcttgggagacgctgctccggcaggtgcagccccggaagtttgtccatgggggtccccgcggctggggctcatggaactgcgagacccgggaccctcctgccctgcgggtccccgagccaccagcagccaggactggaggctgtggggcatggcgtgacttctcgtgcacagggctggtttggttatgagacgatctcgctgggaccgcccctgcccgtggaaagccacaaggacaaagggagcggccacctcgacccccagacaggccggcccgtattaaagttggccctgcacgccca

SEQ ID NO: 116958 - DNA, 611 bp, Homo sapiens
  Payload ID: 2823
  Gene Symbol: CHMP6
  Gene Name: charged multivesicular body protein 6
  ENST ID: ENST00000572525
  CDS Start-End: 272-611
cctgcacaggaagggtgcacggaaacacgtcatttagaacatcccgggcccgaacatcgcgggccctaacatccagcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccagaaaacgtccctgtcaaggccaggcccaggcaggcggagctggtggcag

SEQ ID NO: 116959 - DNA, 737 bp, Homo sapiens
  Payload ID: 2823
  Gene Symbol: CHMP6
  Gene Name: charged multivesicular body protein 6
  ENST ID: ENST00000572778
  CDS Start-End: 1-675
caactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccaggtatttccatgtttgattcttttgaatggttggaattcgcaggagaaaagtggattctagaagggaacaagacagaatgctcccaggccttcctgggccgtgggcaagccctgctgcctggctgtttggcttgggggcgtgcgtgcctggccttggggttgggcttgggtttcccaggggttcggtaactgggcaacctcataagagagccataccccattcaaagagacacattcagaaatcagaactg

SEQ ID NO: 116960 - DNA, 552 bp, Homo sapiens
  Payload ID: 2823
  Gene Symbol: CHMP6
  Gene Name: charged multivesicular body protein 6
  ENST ID: ENST00000571457
  CDS Start-End: 1-522
cgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccagctttgccccaggatgggcctcagttacggaactgcacagaaacacggaaagctaaaactcccatagaaaccttgtccttttggcaagagaaattgtgaacaggggccactgaggtccagaaagcgtgt

SEQ ID NO: 116961 - DNA, 3367 bp, Homo sapiens
  Payload ID: 2824
  Gene Symbol: CHMP7
  Gene Name: charged multivesicular body protein 7
  Uniprot ID: Q8WUX9
  ENST ID: ENST00000313219
  CDS Start-End: 606-1967
tcaatttcattgatttctgctctttttattattttttctcttctgtttaatttgatcttaatttgttcttcttttatagattcccaaggtggaatcttaggttattttagatctttcttcttttctggtttgtgcattcattgatataaatttccctctatacagagattcacggatccatccgggtggtccgggcaccactggcgcccctctgcggctattccccagttccattttctgaagccacaggtcagaagccgctgtacaacgctttgccgaactccagaatcttgaaggagacgtaaggtgcagccacctgccgcgcaggcgcaagcctttctttcggcacaaagaccgtgggaggaggggtcggcgcaagcgctcggtgtctctctgaaaagaacttcatcatactgcctcctggctgacggagcgcagcgcaacgcatgcgccttgaagacttatggaacttatttcacgctcagggcggcggtgacgtgtgaacgagaaggaggtggtcaaggaacggaagccgggagggaacgagggcggaagcggaccagggccaggcttgtgttcgcagccttgccggggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcttgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 116962 - DNA, 3403 bp, Homo sapiens
  Payload ID: 2824
  Gene Symbol: CHMP7
  Gene Name: charged multivesicular body protein 7
  Uniprot ID: Q8WUX9
  ENST ID: ENST00000397677
  CDS Start-End: 649-2010
gctgcctcctctgactgttatgcagcaggccggcaggtcaataaacttgcttgcctgactttgagtatactcgtcttttctcttggccaaccttacggtagctgtaccagtttgcatttccaccagcaatgaatgagagttcctgttgctctgcatcctcaccagcatttggtgtggtcagtattttggattttcaccattctaatagagattcacggatccatccgggtggtccgggcaccactggcgcccctctgcggctattccccagttccattttctgaagccacaggtcagaagccgctgtacaacgctttgccgaactccagaatcttgaaggagacgtaaggtgcagccacctgccgcgcaggcgcaagcctttctttcggcacaaagaccgtgggaggaggggtcggcgcaagcgctcggtgtctctctgaaaagaacttcatcatactgcctcctggctgacggagcgcagcgcaacgcatgcgccttgaagacttatggaacttatttcacgctcagggcggcggtgacgtgtgaacgagaaggaggtggtcaaggaacggaagccgggagggaacgagggcggaagcggaccagggccaggcttgtgttcgcagccttgccggggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcttgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccg

SEQ ID NO: 116963 - DNA, 917 bp, Homo sapiens
  Payload ID: 2824
  Gene Symbol: CHMP7
  Gene Name: charged multivesicular body protein 7
  Uniprot ID: Q8WUX9
  ENST ID: ENST00000519503
  CDS Start-End: 31-522
gttcgcagccttgccggggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagag

SEQ ID NO: 116964 - DNA, 914 bp, Homo sapiens
  Payload ID: 2824
  Gene Symbol: CHMP7
  Gene Name: charged multivesicular body protein 7
  ENST ID: ENST00000519414
  CDS Start-End: 60-533
gggcggaagcggaccagggccaggcttgtgttcgcagccttgccggggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaagtagagattgggtttcaccatgttagccaggatggtctcgatctcctgacctcgtgatccacccgccttggcctcccaaagtgctgggattacaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaa

SEQ ID NO: 116965 - DNA, 2639 bp, Homo sapiens
  Payload ID: 2824
  Gene Symbol: CHMP7
  Gene Name: charged multivesicular body protein 7
  ENST ID: ENST00000517325
  CDS Start-End: 55-294
gaagcggaccagggccaggcttgtgttcgcagccttgccggggctggggttccgatgtggtccccggagcgggaggccgaggccccagccgggggagacccggcgggccttctgccccccgagtgggaggaggacgaggagcgcatgtccttcctgttctccgctttcaagaggagtcgcgagtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcttgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccg

SEQ ID NO: 116966 - DNA, 666 bp, Homo sapiens
  Payload ID: 2824
  Gene Symbol: CHMP7
  Gene Name: charged multivesicular body protein 7
  ENST ID: ENST00000519984
  CDS Start-End: 38-666
ggcttgtgttcgcagccttgccggggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtaccttcccattggactggacattgatattgcccaggatggtctcgaactcctgcactcaagcgatcctcccacctcagcctcccaaagtgttaagattacaggcgttgagccactgcacctggccaacgaggctttctgagatggcatacagtggaaaccgttttcgttcatgcctgaagcagggaacaggagaaacagtagttgaagaagaaaaggctgaggaggtgtatcgtctgtatcagaactcgcccctctcctcccaccccgtggtggccctgtcagagctcagcaccctctgtgctaactcctgcccagatgagaggacctt

SEQ ID NO: 116967 - DNA, 1712 bp, Homo sapiens
  Payload ID: 2825
  Gene Symbol: CHEK1
  Gene Name: checkpoint kinase 1
  ENST ID: ENST00000278916
  CDS Start-End: 21-1319
ccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattct

SEQ ID NO: 116968 - DNA, 4153 bp, Homo sapiens
  Payload ID: 2825
  Gene Symbol: CHEK1
  Gene Name: checkpoint kinase 1
  Uniprot ID: O14757
  ENST ID: ENST00000438015
  CDS Start-End: 898-2328
cttttaaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctg

SEQ ID NO: 116969 - DNA, 1670 bp, Homo sapiens
  Payload ID: 2825
  Gene Symbol: CHEK1
  Gene Name: checkpoint kinase 1
  ENST ID: ENST00000427383
  CDS Start-End: 36-1514
acttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtt

SEQ ID NO: 116970 - DNA, 1845 bp, Homo sapiens
  Payload ID: 2825
  Gene Symbol: CHEK1
  Gene Name: checkpoint kinase 1
  Uniprot ID: O14757
  ENST ID: ENST00000428830
  CDS Start-End: 60-1490
gcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctgatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaa

SEQ ID NO: 116971 - DNA, 661 bp, Homo sapiens
  Payload ID: 2825
  Gene Symbol: CHEK1
  Gene Name: checkpoint kinase 1
  ENST ID: ENST00000527013
  CDS Start-End: 49-661
aggacagtccggtgaggaagggcggccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggag

SEQ ID NO: 116972 - DNA, 562 bp, Homo sapiens
  Payload ID: 2825
  Gene Symbol: CHEK1
  Gene Name: checkpoint kinase 1
  ENST ID: ENST00000526937
  CDS Start-End: 51-562
acagtccggtgaggaagggcggccggtagaccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtacttt

SEQ ID NO: 116973 - DNA, 583 bp, Homo sapiens
  Payload ID: 2825
  Gene Symbol: CHEK1
  Gene Name: checkpoint kinase 1
  ENST ID: ENST00000534685
  CDS Start-End: 203-583
agtccggtgaggaagggcggccgacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataact

SEQ ID NO: 116974 - DNA, 1799 bp, Homo sapiens
  Payload ID: 2825
  Gene Symbol: CHEK1
  Gene Name: checkpoint kinase 1
  Uniprot ID: O14757
  ENST ID: ENST00000524737
  CDS Start-End: 212-1642
gatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggttgaggccttggctcctgcctgtagtcccagctacttaggaggctgagagaggaggatcgcgtgaacctggaagtttgaggctgtagtgagctatgattgcaccagtgcactccagcttggatgacaga

SEQ ID NO: 116975 - DNA, 561 bp, Homo sapiens
  Payload ID: 2825
  Gene Symbol: CHEK1
  Gene Name: checkpoint kinase 1
  ENST ID: ENST00000533778
  CDS Start-End: 435-561
aagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaagccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatga

SEQ ID NO: 116976 - DNA, 769 bp, Homo sapiens
  Payload ID: 2825
  Gene Symbol: CHEK1
  Gene Name: checkpoint kinase 1
  ENST ID: ENST00000525396
  CDS Start-End: 97-450
aggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccaga

SEQ ID NO: 116977 - DNA, 617 bp, Homo sapiens
  Payload ID: 2825
  Gene Symbol: CHEK1
  Gene Name: checkpoint kinase 1
  ENST ID: ENST00000532669
  CDS Start-End: 41-617
ggtgggcaaaggacagtccgccgaggtgctcggtggagtcatggcagtgccctttgtggaagactgggacttggtgcaaaccctgggagaagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaag

SEQ ID NO: 116978 - DNA, 3513 bp, Homo sapiens
  Payload ID: 2825
  Gene Symbol: CHEK1
  Gene Name: checkpoint kinase 1
  Uniprot ID: O14757
  ENST ID: ENST00000534070
  CDS Start-End: 256-1686
gcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaa

SEQ ID NO: 116979 - DNA, 1653 bp, Homo sapiens
  Payload ID: 2825
  Gene Symbol: CHEK1
  Gene Name: checkpoint kinase 1
  Uniprot ID: O14757
  ENST ID: ENST00000544373
  CDS Start-End: 115-1263
tttggattcctgcagtggtgggcaaaggacagtccgccgaggtgctcggtggagtcatggcagtgccctttgtggaagactgggacttggtgcaaaccctgggagaaggtgcctatggagaagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaat

SEQ ID NO: 116980 - DNA, 462 bp, Homo sapiens
  Payload ID: 2825
  Gene Symbol: CHEK1
  Gene Name: checkpoint kinase 1
  ENST ID: ENST00000531607
  CDS Start-End: 131-462
ccgaggtgctcggtggagtcatggcagtgccctttgtggaagactgggacttggtgcaaaccctgggagaagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggc

SEQ ID NO: 116981 - DNA, 755 bp, Homo sapiens
  Payload ID: 2825
  Gene Symbol: CHEK1
  Gene Name: checkpoint kinase 1
  ENST ID: ENST00000498122
  CDS Start-End: 1-270
aaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggttgaggccttggctcctgcctgtagtcccagctacttaggaggctgagagaggaggatcgcgtgaacctggaagtttgaggctgtagtgagctatgattgcaccagtgcactccagcttggatgacagaatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaa

SEQ ID NO: 116982 - DNA, 4051 bp, Homo sapiens
  Payload ID: 2825
  Gene Symbol: CHEK1
  Gene Name: checkpoint kinase 1
  Uniprot ID: O14757
  ENST ID: ENST00000532449
  CDS Start-End: 898-2226
cttttaaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctg

SEQ ID NO: 116983 - DNA, 1771 bp, Homo sapiens
  Payload ID: 2826
  Gene Symbol: CHEK2
  Gene Name: checkpoint kinase 2
  Uniprot ID: O96017
  ENST ID: ENST00000348295
  CDS Start-End: 73-1617
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 116984 - DNA, 1867 bp, Homo sapiens
  Payload ID: 2826
  Gene Symbol: CHEK2
  Gene Name: checkpoint kinase 2
  Uniprot ID: O96017
  ENST ID: ENST00000328354
  CDS Start-End: 83-1714
gtttgtatctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctg

SEQ ID NO: 116985 - DNA, 696 bp, Homo sapiens
  Payload ID: 2826
  Gene Symbol: CHEK2
  Gene Name: checkpoint kinase 2
  ENST ID: ENST00000382565
  CDS Start-End: 73-696
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagagaaaatacttaaaatctactctctcagctga

SEQ ID NO: 116986 - DNA, 1971 bp, Homo sapiens
  Payload ID: 2826
  Gene Symbol: CHEK2
  Gene Name: checkpoint kinase 2
  Uniprot ID: O96017
  ENST ID: ENST00000382580
  CDS Start-End: 77-1837
atctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgagacagagtctggccatgttacccaatctgatcttgaactcctgctgtcatctgatcctcctgcctcagcctcccaaagtgctgggataagaggtgtgaggcaccatccccggccagtttgcagtctaaaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaatt

SEQ ID NO: 116987 - DNA, 713 bp, Homo sapiens
  Payload ID: 2826
  Gene Symbol: CHEK2
  Gene Name: checkpoint kinase 2
  ENST ID: ENST00000398017
  CDS Start-End: 198-713
gcggagagtgtgcggctccaggtgggctcacgcgatactggatttcaccatggtgcccaggctggtcttgaattcctgggctcaagcaatctacctgcgttggcctcccaaagtgctgggattacagacatgaaccaccacacctggcagaacctttgtgaaagatctcaatttaatatggaaataaaaaaatttgtatgctgaggctgctaacgtctatggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagat

SEQ ID NO: 116988 - DNA, 1545 bp, Homo sapiens
  Payload ID: 2826
  Gene Symbol: CHEK2
  Gene Name: checkpoint kinase 2
  Uniprot ID: O96017
  ENST ID: ENST00000402731
  CDS Start-End: 1-1545
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtga

SEQ ID NO: 116989 - DNA, 1359 bp, Homo sapiens
  Payload ID: 2826
  Gene Symbol: CHEK2
  Gene Name: checkpoint kinase 2
  Uniprot ID: O96017
  ENST ID: ENST00000403642
  CDS Start-End: 1-1359
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtga

SEQ ID NO: 116990 - DNA, 1785 bp, Homo sapiens
  Payload ID: 2826
  Gene Symbol: CHEK2
  Gene Name: checkpoint kinase 2
  Uniprot ID: O96017
  ENST ID: ENST00000404276
  CDS Start-End: 1-1632
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctg

SEQ ID NO: 116991 - DNA, 1959 bp, Homo sapiens
  Payload ID: 2826
  Gene Symbol: CHEK2
  Gene Name: checkpoint kinase 2
  Uniprot ID: O96017
  ENST ID: ENST00000405598
  CDS Start-End: 193-1824
ggagagtgtgcggctccaggtgggctcacgcgatactggatttcaccatggtgcccaggctggtcttgaattcctgggctcaagcaatctacctgcgttggcctcccaaagtgctgggattacagacatgaaccaccacacctggcagaacctttgtatcttgaaagctgtgtaaatacaatcagtgtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaatta

SEQ ID NO: 116992 - DNA, 722 bp, Homo sapiens
  Payload ID: 2826
  Gene Symbol: CHEK2
  Gene Name: checkpoint kinase 2
  ENST ID: ENST00000454252
  CDS Start-End: 1-138
tcatctgatcctcctgcctcagcctcccaaagtgctgggataagaggtgtgaggcaccatccccggccagtttgcagtctaatagagacggggtttcaccgtgttagccaggatggtctccatctcctgacctcgtgatcgcccgcctcggcctcccaaagtgctgggaatacagatagatagggtctcactctcactctggagtgagtggtgcaaccacagcttagtgcagcctcgaccttcaggctcaagtgatcctccttccttggcctcccaaagtactgggattacaggtgtgagccatcgtgcccagcccatatggtcttgctctgttgcccaggttggagtacagtggcaggatcacagcccattgtagcatcagcttatcttgctcaagtgatcctcctccttcagcctcctgagtagctggactacagaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaaggtaatattatta

SEQ ID NO: 116993 - DNA, 752 bp, Homo sapiens
  Payload ID: 2826
  Gene Symbol: CHEK2
  Gene Name: checkpoint kinase 2
  ENST ID: ENST00000425190
  CDS Start-End: 388-752
gctgaggctgcggagagtgtgcggctccaggtgggctcacgcgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtat

SEQ ID NO: 116994 - DNA, 588 bp, Homo sapiens
  Payload ID: 2826
  Gene Symbol: CHEK2
  Gene Name: checkpoint kinase 2
  ENST ID: ENST00000456369
  CDS Start-End: 1-434
agatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 116995 - DNA, 553 bp, Homo sapiens
  Payload ID: 2826
  Gene Symbol: CHEK2
  Gene Name: checkpoint kinase 2
  ENST ID: ENST00000439346
  CDS Start-End: 1-174
ttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcaggtaaaagaagccctcaattcttttgacagctgcctttcttttagttgaattactccctgaattaggcagaaatc

SEQ ID NO: 116996 - DNA, 900 bp, Homo sapiens
  Payload ID: 2826
  Gene Symbol: CHEK2
  Gene Name: checkpoint kinase 2
  ENST ID: ENST00000447421
  CDS Start-End: 7-900
gtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaggaaaatttgtcctgtccttacagaatatggtttaatggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaag
